US008048431B2

(12) United States Patent
Haynes

(10) Patent No.: US 8,048,431 B2
(45) Date of Patent: Nov. 1, 2011

(54) MODIFIED HIV-1 CLADE C ENVELOPE GLYCOPROTEIN IMMUNOGENS COMPRISING DELETIONS IN THE GP120/GP41 CLEAVAGE SITE AND GP41 FUSION DOMAIN

(75) Inventor: Barton F. Haynes, Durham, NC (US)

(73) Assignee: Duke University, Durham, NC (US)

( * ) Notice: Subject to any disclaimer, the term of this patent is extended or adjusted under 35 U.S.C. 154(b) by 391 days.

(21) Appl. No.: 11/896,934

(22) Filed: Sep. 6, 2007

(65) Prior Publication Data

US 2009/0162384 A1 Jun. 25, 2009

Related U.S. Application Data

(63) Continuation-in-part of application No. 10/572,638, filed as application No. PCT/US2004/030397 on Sep. 17, 2004.

(60) Provisional application No. 60/503,460, filed on Sep. 17, 2003, provisional application No. 60/604,722, filed on Aug. 27, 2004.

(51) Int. Cl.
*A61K 39/21* (2006.01)

(52) U.S. Cl. .................................................... 424/208.1

(58) Field of Classification Search ........................ None
See application file for complete search history.

(56) References Cited

U.S. PATENT DOCUMENTS

2003/0044421 A1 3/2003 Emini et al.
2003/0096778 A1 5/2003 Shiver et al.
2007/0178562 A1 8/2007 Haynes et al.

FOREIGN PATENT DOCUMENTS

JP 2003-523188 8/2003
WO WO 01/60838 8/2001

OTHER PUBLICATIONS

Wang, L.-X., 2003, Bioorganic Approaches Towards HIV Vaccine Design, Curr. Pharm. Des. 9:1771-1787.*

Gallo, R. C., 2005, The End or the Beginning of the Drive to an HIV-Preventive Vaccine: a View From Over 20 Years, The Lancet, 366(9500):1894-1898.*

Walker, B. D., and D. R. Burton, 2008, Toward an AIDS Vaccine, Science 320:760-764.*

Levine, a. J., 2008, Why Do We Not Yet Have a Human Immunodeficiency Virus Vaccine? J. Virol. 82(24):11998-12000.*

Supplementary Partial European Search Report dated Aug. 1, 2008—EP Appln. No. 04 78 4298.

Gaschen et al, "Diversity Considerations in HIV-1 Vaccine Selection", Science 296 (5577):2354-2360 (2003).

Nickle et al, "Consensus and Ancestral State HIV Vaccines", Science 299(5612):1515-1518 (2003).

International Search Report issued in connection with PCT/US04/30397 dated Mar. 8, 2005.

(Continued)

*Primary Examiner* — Jeffrey Parkin
(74) *Attorney, Agent, or Firm* — Nixon & Vanderhye P.C.

(57) ABSTRACT

The present invention relates, in general, to an immunogen and, in particular, to an immunogen for inducing antibodies that neutralize a wide spectrum of HIV primary isolates and/or to an immunogen that induces a T cell immune response. The invention also relates to a method of inducing anti-HIV antibodies, and/or to a method of inducing a T cell immune response, using such an immunogen. The invention further relates to nucleic acid sequences encoding the present immunogens.

1 Claim, 227 Drawing Sheets

Wild-type subtype C
DU123.6 gp160(854 a.a)
MRVKGIQRNWPQWWIWGILGFWMIIICRVVGNLWVTVYYGVPVWTEAKTTLFCASDAKAYEREVHNVWATHACVPTDPNPQEIVL
GNVTENFNMWKNDMVDQMHEDIISIWDQSLKPCVKLTPLCVTLNCTDVKVNATSNGTTTYNNSIDSMNGEIKNCSFNITTEIRDK
KQKVYALFYRPDVVPLNENSSSYILINCNTSTTTQACPKVSFDPIPIHYCAPAGYAILKCNNKTFNGTGPCHNVSTVQCTHGIKP
VVSTQLLLNGSLAEEEIIIRSENLTNNAKTIIVHLNESIEIVCTRPNNNTRKSIRIGPGQTVYATNDIIGDIRQAHCNISKTKWN
TTLEKVKEKLKEHFPSKAITFQPHSGGDLEVTTHSFNCRGEFFYCDTTKLFNESNLNTTNTTTLTLPCRIKQIVNMWQGVGRAMY
APPVEGNITCNSSITGLLLVRDGGNTSNSTPEIFRPGGGNMKDNWRSELYKYKVVEIKPLGVAPTKAKRRVVEREKRAVGIGAVL
FGFLGAAGSTMGAASITLTVQARQLLSGIVQQQSNLLRAIEAQQHMLQLTVWGIKQLQARVLAIERYLKDQQLLGLWGCSGKLIC
PTTVPWNSSWSNKSQTDIWDNMTWMQWDREISNYTGTIYKLLEESQNQQEKNEKDLLALDSWKNLWSWFDITNWLWYIKIFIMIV
GGLIGLRIIFGVLSIVKRVRQGYSPLSFQTLTPNPRGLDRLGRIEEEGGEQDKDRSIRLVNGFLALAWDDLRSLCLFSYHRLRDF
ILVAARAVELLGRSSLRGLQRGWEALKYLGNLVQYGGLELKRRAISLFDTIAIAVAEGTDRILEVILRIIRAIRNIPTRIRQGFE
AALL

DU123.6 140CF (638 a.a)
Nick name: 013
MRVKGIQRNWPQWWIWGILGFWMIIICRVVGNLWVTVYYGVPVWTEAKTTLFCASDAKAYEREVHNVWATHACVPTDPNPQEIVL
GNVTENFNMWKNDMVDQMHEDIISIWDQSLKPCVKLTPLCVTLNCTDVKVNATSNGTTTYNNSIDSMNGEIKNCSFNITTEIRDK
KQKVYALFYRPDVVPLNENSSSYILINCNTSTTTQACPKVSFDPIPIHYCAPAGYAILKCNNKTFNGTGPCHNVSTVQCTHGIKP
VVSTQLLLNGSLAEEEIIIRSENLTNNAKTIIVHLNESIEIVCTRPNNNTRKSIRIGPGQTVYATNDIIGDIRQAHCNISKTKWN
TTLEKVKEKLKEHFPSKAITFQPHSGGDLEVTTHSFNCRGEFFYCDTTKLFNESNLNTTNTTTLTLPCRIKQIVNMWQGVGRAMY
APPVEGNITCNSSITGLLLVRDGGNTSNSTPEIFRPGGGNMKDNWRSELYKYKVVEIKPLGVAPTKAKTLTVQARQLLSGIVQQQ
SNLLRAIEAQQHMLQLTVWGIKQLQARVLAIERYLKDQQLLGLWGCSGKLICPTTVPWNSSWSNKSQTDIWDNMTWMQWDREISN
YTGTIYKLLEESQNQQEKNEKDLLALDSWKNLWSWFDITNWLW*
*Amino acids seen in blue color is for easy identification of the junction of the deleted fusion cleavage site.

OTHER PUBLICATIONS

Supplementary Partial European Search Report issued in connection with EP 04 78 4298 dated Aug. 1, 2008.
Gao et al., "Centralized immunogens as a vaccine strategy to overcome HIV-1 diversity", Expert Rev. Vaccines 3(4):S161-168 (2004).
Liao et al., "A Group M Consensus Envelope Glycoprotein induces Antibodies That Neutralize Subsets of Subtype B and C HIV-1 Primary Viruses," NIH Public Access, pp. 1-30, Published in final edited form as Virology 353(2):268-282 (2006).
Leitner, T. et al., eds., "HIV Sequence Compendium 2003"; Theoretical Biology and Biophysics Group, Los Alamos National Laboratory, LA-UR No. 04-7420, pp. 513-573 and attached appendix.
Morris et al., "Characterization and selection of HIV-1 subtype C isolates for use in vaccine development", AIDS Res Hum Retroviruses., 19(2):133-44 (2003)—Abstract.
Novitsky et al., "Human Immunodeficiency Vrius Type 1 Subtype C Molecular Phylogeny: Consensus Sequence for an AIDS Vaccine Design?", Journal of Virology, vol. 76, No. 11, pp. 5435-5451 (2002).
Ellenberger et al., "Generation of a Consensus Sequence from Prevalent and Incident HIV-1 Infections in West Africa to Guide AIDS Vaccine Development[1,2]", Virology 302, pp. 155-163 (2002).
Demi et al., "Multiple Effects of Codon Usage Optimization on Expression and Immunogenicity of DNA Candidate Vaccines Encoding the Human Immunodeficiency Virus Type 1 Gag Protein", Journal of Virology, vol. 75, No. 22 pp. 10991-11001 (2001).
Gao et al., "Codon usage optimization of HIV type 1 subtype C gag, pol, env, and nef genes: in vitro expression and immune responses in DNA-vaccinated mice", AIDS Res Hum Retroviruses, 19(9):817-23 (2003)—Abstract.
Williamson et al, "Characterization and selection of HIV-1 subtype C isolates for use in vaccine development", AIDS Res. Hum. Retroviruses 19(2):133-144 (2003)—Abstract.
Kofman et al, "HIV-1 gag expression is quantitatively dependent on the ratio of native and optimized codons", Tsitologiia 45(1):86-93 (2003)—Abstract.
Office Action dated Nov. 30, 2009 in U.S. Appl. No. 10/572,638.
Office Action dated Jun. 4, 2010 in U.S. Appl. No. 10/572,638.
Notice of Allowance dated Jan. 4, 2011 in U.S. Appl. No. 10/572,638.
Notice of Allowance dated May 12, 2011 in U.S. Appl. No. 10/572,638.

* cited by examiner

MRVMGIQRNCQHLWRWGTMILGMLMICSAAENLWVTVYYGVPVWKEANTTLFCASDAKAYDTEVHNVWAT

V1

HACVPTDPNPQEIVLENVTENFNMWKNNMVEQMHEDIISLWDQSLKPCVKLTPLCVTLNCTNVRNVSSNG

V2

TETDNEEIKNCSFNITTELRDKKQKVYALFYRLDVVPIDDKNSSEISGKNSSEYYRLINCNTSAITQACP

KVSFEPIPIHYCAPAGFAILKCNDKKFNGTGPCKNVSTVQCTHGIKPVVSTQLLLNGSLAEEEIIIRSEN

V3

ITNNAKTIIVQLNESVEINCTRPNNNTRKSIHIGPGQAFYATGEIIGDIRQAHCNISRTKWNKTLQQVAK

V4

KLREHFNNKTIIFKPSSGGDLEITTHSFNCGGEFFYCNTSGLFNSTWMFNGTYMFNGTKDNSETITLPCR

V5

IKQIINMWQGVGQAMYAPPIEGKITCKSNITGLLLTRDGGNNSNKNKTETFRPGGGDMRDNWRSELYKYK

VVKIEPLGVAPTKAKRRVVEREKRAVGIGAVFLGFLGAAGSTMGAASITLTVQARQLLSGIVQQQSNLLR

AIEAQQHLLQLTVWGIKQLQARVLAVERYLKDQQLLGIWGCSGKLICTTNVPWNSSWSNKSQDEIWDNMT

WMEWEREISNYTDIIYRLIEESQNQQEKNEQELLALDKWASLWNWFDITNWLWYIKIFIMIVGGLIGLRI

VFAVLSIVNRVRQGYSPLSFQTLIPNPRGPDRPEGIEEEGGEQGRDRSIRLVNGFLALAWDDLRSLCLFS

YHRLRDFILIAARTVELLGRRSLRGLQKGWEALKYLGNLLQYWGQELKNSAISLLDTTAIAVAEGTDRVI

EIVQRACRAILNIPRRIRQGLERALL

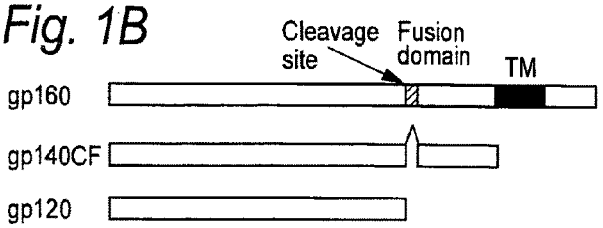

Fig. 1C

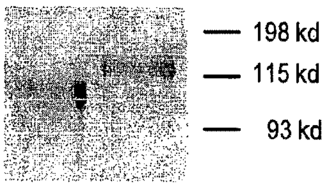

Fig. 1D

CON6.env (group M env consensus. This one contain five variable regions in env gene from 98CN006 virus, not in the public domain yet)

GCCACCATGCGCGTGATGGGCATCCAGCGCAACTGCCAGCACCTGTGGCGCTGGGGCACCATGATC
CTGGGCATGCTGATGATCTGCTCCGCCGCCGAGAACCTGTGGGTGACCGTGTACTACGGC
GTGCCCGTGTGGAAGGAGGCCAACACCACCCTGTTCTGCGCCTCCGACGCCAAGGCCTAC
GACACCGAGGTGCACAACGTGTGGGCCACCCACGCCTGCGTGCCCACCGACCCCAACCCC
CAGGAGATCGTGCTGGAGAACGTGACCGAGAACTTCAACATGTGGAAGAACAACATGGTG
GAGCAGATGCACGAGGACATCATCTCCCTGTGGGACCAGTCCCTGAAGCCCTGCGTGAAG
CTGACCCCCCTGTGCGTGACCCTGAACTGCACCAACGTGCGCAACGTGTCCTCCAACGGC
ACCGAGACCGACAACGAGGAGATCAAGAACTGCTCCTTCAACATCACCACCGAGCTGCGC
GACAAGAAGCAGAAGGTGTACGCCCTGTTCTACCGCCTGGACGTGGTGCCCATCGACGAC
AAGAACTCCTCCGAGATCTCCGGCAAGAACTCCTCCGAGTACTACCGCCTGATCAACTGC
AACACCTCCGCCATCACCCAGGCCTGCCCCAAGGTGTCCTTCGAGCCCATCCCCATCCAC
TACTGCGCCCCCGCCGGCTTCGCCATCCTGAAGTGCAACGACAAGAAGTTCAACGGCACC
GGCCCCTGCAAGAACGTGTCCACCGTGCAGTGCACCCACGGCATCAAGCCCGTGGTGTCC
ACCCAGCTGCTGCTGAACGGCTCCCTGGCCGAGGAGGAGATCATCATCCGCTCCGAGAAC
ATCACCAACAACGCCAAGACCATCATCGTGCAGCTGAACGAGTCCGTGGAGATCAACTGC
ACCCGCCCCAACAACAACACCCGCAAGTCCATCCACATCGGCCCCGGCCAGGCCTTCTAC
GCCACCGGCGAGATCATCGGCGACATCCGCCAGGCCCACTGCAACATCTCCCGCACCAAG
TGGAACAAGACCCTGCAGCAGGTGGCCAAGAAGCTGCGCGAGCACTTCAACAACAAGACC
ATCATCTTCAAGCCCTCCTCCGGCGGCGACCTGGAGATCACCACCCACTCCTTCAACTGC
GGCGGCGAGTTCTTCTACTGCAACACCTCCGGCCTGTTCAACTCCACCTGGATGTTCAAC
GGCACCTACATGTTCAACGGCACCAAGGACAACTCCGAGACCATCACCCTGCCCTGCCGC
ATCAAGCAGATCATCAACATGTGGCAGGGCGTGGGCCAGGCCATGTACGCCCCCCCCATC
GAGGGCAAGATCACCTGCAAGTCCAACATCACCGGCCTGCTGCTGACCCGCGACGGCGGC
AACAACTCCAACAAGAACAAGACCGAGACCTTCCGCCCCGGCGGCGGCGACATGCGCGAC
AACTGGCGCTCCGAGCTGTACAAGTACAAGGTGGTGAAGATCGAGCCCCTGGGCGTGGCC
CCCACCAAGGCCAAGCGCCGCGTGGTGGAGCGCGAGAAGCGCGCCGTGGGCATCGGCGCC
GTGTTCCTGGGCTTCCTGGGCGCCGCCGGCTCCACCATGGGCGCCGCCTCCATCACCCTG
ACCGTGCAGGCCCGCCAGCTGCTGTCCGGCATCGTGCAGCAGCAGTCCAACCTGCTGCGC
GCCATCGAGGCCCAGCAGCACCTGCTGCAGCTGACCGTGTGGGGCATCAAGCAGCTGCAG
GCCCGCGTGCTGGCCGTGGAGCGCTACCTGAAGGACCAGCAGCTGCTGGGCATCTGGGGC
TGCTCCGGCAAGCTGATCTGCACCACCAACGTGCCCTGGAACTCCTCCTGGTCCAACAAG
TCCCAGGACGAGATC TGGGACAACATGACCTGGATGGAGTGGGAGCGCGAGATCTCCAAC
TACACCGACATCATCTACCGCCTGATCGAGGAGTCCCAGAACCAGCAGGAGAAGAACGAG
CAGGAGCTGCTGGCCCTGGACAAGTGGGCCTCCCTGTGGAACTGGTTCGACATCACCAAC
TGGCTGTGGTACATCAAGATCTTCATCATGATCGTGGGCGGCCTGATCGGCCTGCGCATC
GTGTTCGCCGTGCTGTCCATCGTGAACCGCGTGCGCCAGGGCTACTCCCCCCTGTCCTTC
CAGACCCTGATCCCCAACCCCCGCGGCCCCGACCGCCCCGAGGGCATCGAGGAGGAGGGC
GGCGAGCAGGGCCGCGACCGCTCCATCCGCCTGGTGAACGGCTTCCTGGCCCTGGCCTGG
GACGACCTGCGCTCCCTGTGCCTGTTCTCCTACCACCGCCTGCGCGACTTCATCCTGATC
GCCGCCCGCACCGTGGAGCTGCTGGGCCGCCGCTCCCTGCGCGGCCTGCAGAAGGGCTGG
GAGGCCCTGAAGTACCTGGGCAACCTGCTGCAGTACTGGGGCCAGGAGCTGAAGAACTCC
GCCATCTCCCTGCTGGACACCACCGCCATCGCCGTGGCCGAGGGCACCGACCGCGTGATC
GAGATCGTGCAGCGCGCCTGCCGCGCCATCCTGAACATCCCCCGCCGCATCCGCCAGGGC
CTGGAGCGCGCCCTGCTGTAA

Fig. 6A

C.anc.env (subtype C ancestral env. The amino acid sequence is different from Los Alamos Database August 2002)

GCCGCCATGCGCGTGATGGGCATCCTGCGCAACTGCCAGCAGTGGTGGAT
CTGGGGCATCCTGGGCTTCTGGATGCTGATGATCTGCTCCGTGGTGGGCA
ACCTGTGGGTGACCGTGTACTACGGCGTGCCCGTGTGGAAGGAGGCCAAG
ACCACCCTGTTCTGCGCCTCCGACGCCAAGGCCTACGAGCGCGAGGTGCA
CAACGTGTGGGCCACCCACGCCTGCGTGCCCACCGACCCCAACCCCCAGG
AGATGGTGCTGGAGAACGTGACCGAGAACTTCAACATGTGGAAGAACGAC
ATGGTGGACCAGATGCACGAGGACATCATCTCCCTGTGGGACCAGTCCCT
GAAGCCCTGCGTGAAGCTGACCCCCCTGTGCGTGACCCTGAACTGCACCA
ACGTGACCAACGCCACCAACAACACCTACAACGGCGAGATGAAGAACTGC
TCCTTCAACATCACCACCGAGCTGCGCGACAAGAAGAAGAAGGAGTACGC
CCTGTTCTACCGCCTGGACATCGTGCCCCTGAACGAGAACTCCTCCGAGT
ACCGCCTGATCAACTGCAACACCTCCGCCATCACCCAGGCCTGCCCCAAG
GTGTCCTTCGACCCCATCCCCATCCACTACTGCGCCCCCGCCGGCTACGC
CATCCTGAAGTGCAACAACAAGACCTTCAACGGCACCGGCCCCTGCAACA
ACGTGTCCACCGTGCAGTGCACCCACGGCATCAAGCCCGTGGTGTCCACC
CAGCTGCTGCTGAACGGCTCCCTGGCCGAGGAGGAGATCATCATCCGCTC
CGAGAACCTGACCGACAACGCCAAGACCATCATCGTGCAGCTGAACGAGT
CCGTGGAGATCGTGTGCACCCGCCCCAACAACAACACCCGCAAGTCCATG
CGCATCGGCCCCGGCCAGACCTTCTACGCCACCGGCGACATCATCGGCGA
CATCCGCCAGGCCCACTGCAACATCTCCGAGGACAAGTGGAACAAGACCC
TGCAGCAGGTGGCCGAGAAGCTGGGCAAGCACTTCCCCAACAAGACCATC
ACCTTCGAGCCCTCCTCCGGCGGCGACCTGGAGATCACCACCCACTCCTT
CAACTGCCGCGGCGAGTTCTTCTACTGCAACACCTCCAAGCTGTTCAACT
CCACCTACAACAACAACACCAACTCCAACTCCACCATCACCCTGCCCTGC
CGCATCAAGCAGATCATCAACATGTGGCAGGGCGTGGGCCAGGCCATGTA
CGCCCCCCCCATCGCCGGCAACATCACCTGCAAGTCCAACATCACCGGCC
TGCTGCTGACCCGCGACGGCGGCAAGGAGAACACCACCGAGACCTTCCGC
CCCGGCGGCGGCGACATGCGCGACAACTGGCGCTCCGAGCTGTACAAGTA
CAAGGTGGTGGAGATCAAGCCCCTGGGCGTGGCCCCCACCGAGGCCAAGC
GCCGCGTGGTGGAGCGCGAGAAGCGCGCCGTGGGCCTGGGCGCCGTGTTC
CTGGGCTTCCTGGGCGCCGCCGGCTCCACCATGGGCGCCGCCTCCATCAC
CCTGACCGTGCAGGCCCGCCAGCTGCTGTCCGGCATCGTGCAGCAGCAGT
CCAACCTGCTGCGCGCCATCGAGGCCCAGCAGCACATGCTGCAGCTGACC
GTGTGGGGCATCAAGCAGCTGCAGGCCCGCGTGCTGGCCATGGAGCGCTA
CCTGAAGGACCAGCAGCTGCTGGGCATCTGGGGCTGCTCCGGCAAGCTGA
TCTGCACCACCGCCGTGCCCTGGAACTCCTCCTGGTCCAACAAGTCCCTG
GACGACATCTGGGACAACATGACCTGGATGGAGTGGGACCGCGAGATCTC
CAACTACACCGACACCATCTACCGCCTGCTGGAGGAGTCCCAGAACCAGC
AGGAGAAGAACGAGCAGGACCTGCTGGCCCTGGACTCCTGGGAGAACCTG
TGGAACTGGTTCGACATCACCAACTGGCTGTGGTACATCAAGATCTTCAT
CATGATCGTGGGCGGCCTGATCGGCCTGCGCATCATCTTCGCCGTGCTGT
CCATCGTGAACCGCGTGCGCCAGGGCTACTCCCCCCTGTCCTTCCAGACC
CTGACCCCCAACCCCCGCGGCCCCGACCGCCTGGAGCGCATCGAGGAGGA
GGGCGGCGAGCAGGACCGCGACCGCTCCATCCGCCTGGTGTCCGGCTTCC
TGGCCCTGGCCTGGGACGACCTGCGCTCCCTGTGCCTGTTCTCCTACCAC
CGCCTGCGCGACTTCATCCTGATCGCCGCCCGCACCGTGGAGCTGCTGGG
CCGCTCCTCCCTGCGCGGCCTGCAGCGCGGCTGGGAGGCCCTGAAGTACC
TGGGCTCCCTGGTGCAGTACTGGGGCCAGGAGCTGAAGAAGTCCGCCATC
TCCCTGCTGGACACCATCGCCATCGCCGTGGCCGAGGGCACCGACCGCAT
CATCGAGGTGGTGCAGCGCGCCTGCCGCGCCATCCTGAACATCCCCCGCC
GCATCCGCCAGGGCTTCGAGGCCGCCCTGCTGTAA

Fig. 6B

C.con.env (subtype C consensus env. The amino acid sequence is different from Los Alamos Database August 2002)

GCCGCCATGCGCGTGATGGGCATCCTGCGCAACTGCCAGCAGTGGTGGAT
CTGGGGCATCCTGGGCTTCTGGATGCTGATGATCTGCAACGTGGTGGGCA
ACCTGTGGGTGACCGTGTACTACGGCGTGCCCGTGTGGAAGGAGGCCAAG
ACCACCCTGTTCTGCGCCTCCGACGCCAAGGCCTACGAGAAGG AGGTGCA
CAACGTGTGGGCCACCCACGCCTGCGTGCCCACCGACCCCAACCCCCAGG
AGATGGTGCTGGAGAACGTGACCGAGAACTTCAACATGTGGAAGAACGAC
ATGGTGGACCAGATGCACGAGGACATCATCTCCCTGTGGGACCAGTCCCT
GAAGCCCTGCGTGAAGCTGACCCCCCTGTGCGTGACCCTGAACTGCCGCA
ACGTGACCAACGCCACCAACAACACCTACAACGAGGAGATCAAG AACTGC
TCCTTCAACATCACCACCGAGCTGCGCGACAAGAAGAAGAAGGTGTACGC
CCTGTTCTACCGCCTGGACATCGTGCCCCTGAACGAGAACTCCTCCGAGT
ACCGCCTGATCAACTGCAACACCTCCGCCATCACCCAGGCCTGCCCCAAG
GTGTCCTTCGACCCCATCCCCATCCACTACTGCGCCCCCGCCGGCTACGC
CATCCTGAAGTGCAACAACAAGACCTTCAACGGCACCGGCCCCTG CAACA
ACGTGTCCACCGTGCAGTGCACCCACGGCATCAAGCCCGTGGTGTCCACC
CAGCTGCTGCTGAACGGCTCCCTGGCCGAGGAGGAGATCATCATCCGCTC
CGAGAACCTGACCAACAACGCCAAGACCATCATCGTGCACCTGAACGAGT
CCGTGGAGATCGTGTGCACCCGCCCCAACAACAACACCCGCAAGTCCATC
CGCATCGGCCCCGGCCAGACCTTCTACGCCACCGGCGACATCATCG GCGA
CATCCGCCAGGCCCACTGCAACATCTCCGAGGACAAGTGGAACAAGACCC
TGCAGCGCGTGTCCAAGAAGCTGAAGGAGCACTTCCCCAACAAGACCATC
AAGTTCGAGCCCTCCTCCGGCGGCGACCTGGAGATCACCACCCACTCCTT
CAACTGCCGCGGCGAGTTCTTCTACTGCAACACCTCCAAGCTGTTCAACT
CCACCTACAACAACAACACCAACTCCAACTCCACCATCACCCTGCCC TGC
CGCATCAAGCAGATCATCAACATGTGGCAGGAGGTGGGCCGCGCCATGTA
CGCCCCCCCCATCGCCGGCAACATCACCTGCAAGTCCAACATCACCGGCC
TGCTGCTGACCCGCGACGGCGGCAAGAAGAACACCACCGAGATCTTCCGC
CCCGGCGGCGGCGACATGCGCGACAACTGGCGCTCCGAGCTGTACAAGTA
CAAGGTGGTGGAGATCAAGCCCCTGGGCGTGGCCCCCACCAAGGCCAA GC
GCCGCGTGGTGGAGCGCGAGAAGCGCGCCGTGGGCATCGGCGCCGTGTTC
CTGGGCTTCCTGGGCGCCGCCGGCTCCACCATGGGCGCCGCCTCCATCAC
CCTGACCGTGCAGGCCCGCCAGCTGCTGTCCGGCATCGTGCAGCAGCAGT
CCAACCTGCTGCGCGCCATCGAGGCCCAGCAGCACATGCTGCAGCTGACC
GTGTGGGGCATCAAGCAGCTGCAGACCCGCGTGCTGGCCATCGAGCGCTA
CCTGAAGGACCAGCAGCTGCTGGGCATCTGGGGCTGCTCCGGCAAGCTGA
TCTGCACCACCGCCGTGCCCTGGAACTCCTCCTGGTCCAACAAGTCCCAG
GAGGACATCTGGGACAACATGACCTGGATGCAGTGGGACCGCGAGATCTC
CAACTACACCGACACCATCTACCGCCTGCTGGAGGACTCCCAGAACCAGC
AGGAGAAGAACGAGAAGGACCTGCTGGCCCTGGACTCCTGGAAGAACCTG
TGGAACTGGTTCGACATCACCAACTGGCTGTGGTACATCAAGATCTTCAT
CATGATCGTGGGCGGCCTGATCGGCCTGCGCATCATCTTCGCCGTGCTGT
CCATCGTGAACCGCGTGCGCCAGGGCTACTCCCCCCTGTCCTTCCAGACC
CTGACCCCCAACCCCCGCGGCCCCGACCGCCTGGGCCGCATCGAGGAGGA
GGGCGGCGAGCAGGACCGCGACCGCTCCATCCGCCTGGTGTCCGGCTTCC
TGGCCCTGGCCTGGGACGACCTGCGCTCCCTGTGCCTGTTCTCCTACCAC
CGCCTGCGCGACTTCATCCTGGTGGCCGCCCGCGCCGTGGAGCTGCTGGG
CCGCTCCTCCCTGCGCGGCCTGCAGCGCGGCTGGGAGGCCCTGAAGTACC
TGGGCTCCCTGGTGCAGTACTGGGGCCTGGAGCTGAAGAAGTCCGCCATC
TCCCTGCTGGACACCATCGCCATCGCCGTGGCCGAGGGCACCGACCGCAT
CATCGAGCTGATCCAGCGCATCTGCCGCGCCATCCGCAACATCCCCCGCC
GCATCCGCCAGGGCTTCGAGGCCGCCCTGCAGTAA

Fig. 6C

C.anc.env (subtype C ancestral env)

MRVMGILRNCQQWWIWGILGFWMLMICSVVGNLWVTVYYGVPVWKEAKTTLFCASDAKAYEREVHNVWAT
HACVPTDPNPQEMVLENVTENFNMWKNDMVDQMHEDIISLWDQSLKPCVKLTPLCVTLNCTNVTNATNNT
YNGEMKNCSFNITTELRDKKKKEYALFYRLDIVPLN ENSSEYRLINCNTSAITQACPKVSFDPIPIHYCA
PAGYAILKCNNKTFNGTGPCNNVSTVQCTHGIKPVVSTQLLLNGSLAEEEIIIRSENLTDNAKTIIVQLN
ESVEIVCTRPNNNTRKSMRIGPGQTFYATGDIIGDIRQAHCNISEDKWNKTLQQVAEKLGKHFPNKTITF
EPSSGGDLEITTHSFNCRGEFFYCNTSKLFNSTYNNNTNSNSTITLPCRIKQIINMWQGVGQAMYAPPIA
GNITCKSNITGLLLTRDGGKENTTETFRPGGGDMRDNWRSELYKYKVVEIKPLGVAPTEAKRRVVEREKR
AVGLGAVFLGFLGAAGSTMGAASITLTVQARQLLSGIVQQQSNLLRAIEAQQHMLQLTVWGIKQLQARVL
AMERYLKDQQLLGIWGCSGKLICTTAVPWNSSWSNKSLDDIWDNMTWMEWDREISNYTDTIYRLLEESQN
QQEKNEQDLLALDSWENLWNWFDITNWLWYIKIFIMIVGGLIGLRIIFAVL SIVNRVRQGYSPLSFQTLT
PNPRGPDRLERIEEEGGEQDRDRSIRLVSGFLALAWDDLRSLCLFSYHRLRDFILIAARTVELLGRSSLR
GLQRGWEALKYLGSLVQYWGQELKKSAISLLDTIAIAVAEGTDRIIEVVQRACRAILNIPRRIRQGFEAA
LL

Fig. 6D

C.con.env (subtype C consensus env)

MRVMGILRNCQQWWIWGILGFWMLMICNVVGNLWVTVYYGVPVWKEA KTTLFCASDAKAYEKEVHNVWAT
HACVPTDPNPQEMVLENVTENFNMWKNDMVDQMHEDIISLWDQSLKPCVKLTPLCVTLNCRNVTNATNNT
YNEEIKNCSFNITTELRDKKKKVYALFYRLDIVPLNENSSEYRLINCNTSAITQACPKVSFDPIPIHYCA
PAGYAILKCNNKTFNGTGPCNNVSTVQCTHGIKPVVSTQLLLNGSLAEEEIIIRSENLTNNAKTIIVHLN
ESVEIVCTRPNNNTRKSIR IGPGQTFYATGDIIGDIRQAHCNISEDKWNKTLQRVSKKLKEHFPNKTIKF
EPSSGGDLEITTHSFNCRGEFFYCNTSKLFNSTYNNNTNSNSTITLPCRIKQIINMWQEVGRAMYAPPIA
GNITCKSNITGLLLTRDGGKKNTTEIFRPGGGDMRDNWRSELYKYKVVEIKPLGVAPTKAKRRVVEREKR
AVGIGAVFLGFLGAAGSTMGAASITLTVQARQLLSGIVQQQSNLLRAIEAQQHMLQLTVWGI KQLQTRVL
AIERYLKDQQLLGIWGCSGKLICTTAVPWNSSWSNKSQEDIWDNMTWMQWDREISNYTDTIYRLLEDSQN
QQEKNEKDLLALDSWKNLWNWFDITNWLWYIKIFIMIVGGLIGLRIIFAVLSIVNRVRQGYSPLSFQTLT
PNPRGPDRLGRIEEEGGEQDRDRSIRLVSGFLALAWDDLRSLCLFSYHRLRDFILVAARAVELLGRSSLR
GLQRGWEALKYLGSLVQYWGLELKKSAISLLDTI AIAVAEGTDRIIELIQRICRAIRNIPRRIRQGFEAA
LQ

*Fig. 6E*

Synthesize entire gene in 80-mer fragments overlapping by 20 residues at the 3' end with invariant sequences at the 5' end.

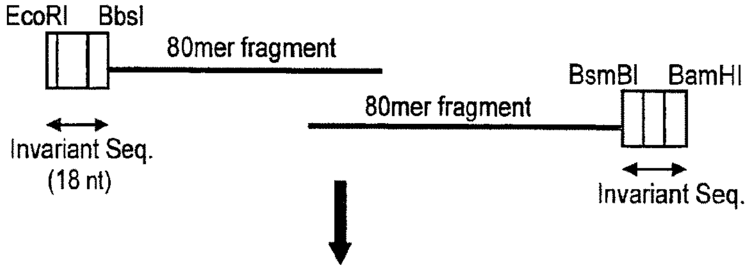

Paired 80mer oligos are connected via PCR in a stepwise manner from 5' to 3' using primers complimentary to the invariant seq.

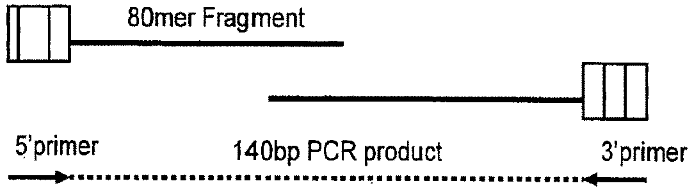

108bp PCR fragments cloned into pGEM-T and sequenced. Clones with the proper sequence will be cut with 2 restriction enzymes. 4 fragments will be ligated together with pcDNA3.1 in a stepwise manner from the 5' to 3' end of gene

| Fragments to be ligated with pcDNA3.1 (1-4 are in order from 5' to 3') | Restriction Enzymes Used to Cleave Fragment |
|---|---|
| Fragment 1 | EcoRI/BsmBI |
| Fragment 2 | BbsI/BsmBI |
| Fragment 3 | BbsI/BsmBI |
| Fragment 4 | BbsI/BamHI |
| pcDNA3.1 | EcoRI/BamHI |

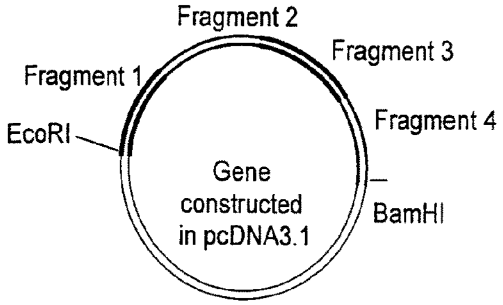

Ligations will be repeated stepwise 5' to 3' until the entire gene has been cloned into pcDNA3.1

Fig. 8

MRVMGILRNCQQWWIWGILGFWMLMICNVVGNLWVTVYYGVPVWKEAKTTLFCASDAKAYEKEVHNVWATHACVPTDPNPQEMVLENVTENFNMWKNDMVDQMHEDIISLWDQSLKPCVKLTPLC

MRVMGILRNCQQWWIWGILGFWMLMICSVVGNLWVTVYYGVPVWKEAKTTLFCASDAKAYEREVHNVWATHACVPTDPNPQEMVLENVTENFNMWKNDMVDQMHEDIISLWDQSLKPCVKLTPLC

V1 V2

VTLNCRNVTNATNNTYNEEIKNCSFNITTELRDKKKKVYALFYRLDIVPLNENSSEYRLINCNTSAITQACPKVSFDPIPIHYCAPAGYAILKCNNKTFNGTGPCNNVSTVQCTHGIKPVVSTQL

VTLNCTNVTNATNNTYNGEMKNCSFNITTELRDKKKKEYALFYRLDIVPLNENSSEYRLINCNTSAITQACPKVSFDPIPIHYCAPAGYAILKCNNKTFNGTGPCNNVSTVQCTHGIKPVVSTQL

V3

LLNGSLAEEEIIIRSENLTNNAKTIIVHLNESVEIVCTRPNNNTRKSIRIGPGQTFYATGDIIGDIRQAHCNISEDKWNKTLQRVSKKLKEHFPNKTIKFEPSSGGDLEITTHSFNCRGEFFYCN

LLNGSLAEEEIIIRSENLTDNAKTIIVQLNESVEIVCTRPNNNTRKSMRIGPGQTFYATGDIIGDIRQAHCNISEDKWNKTLQQVAEKLGKHFPNKTITFEPSSGGDLEITTHSFNCRGEFFYCN

V4 V5

TSKLFNSTYNNNTNSNSTITLPCRIKQIINMWQEVGRAMYAPPIAGNITCKSNITGLLLTRDGGKKNTTEIFRPGGGDMRDNWRSELYKYKVVEIKPLGVAPTKAKRRVVEREKRAVGIGAVFLG

TSKLFNSTYNNNTNSNSTITLPCRIKQIINMWQGVGQAMYAPPIAGNITCKSNITGLLLTRDGGKENTTETFRPGGGDMRDNWRSELYKYKVVEIKPLGVAPTEAKRRVVEREKRAVGLGAVFLG gp120 ↑ gp41

FLGAAGSTMGAASITLTVQARQLLSGIVQQQSNLLRAIEAQQHMLQLTVWGIKQLQTRVLAIERYLKDQQLLGIWGCSGKLICTTAVPWNSSWSNKSQEDIWDNMTWMQWDREISNYTDTIYRLL

FLGAAGSTMGAASITLTVQARQLLSGIVQQQSNLLRAIEAQQHMLQLTVWGIKQLQARVLAMERYLKDQQLLGIWGCSGKLICTTAVPWNSSWSNKSLDDIWDNMTWMEWDREISNYTDTIYRLL

EDSQNQQEKNEKDLLALDSWKNLWNWFDITNWLWYIKIFIMIVGGLIGLRIIFAVLSIVNRVRQGYSPLSFQTLTPNPRGPDRLGRIEEEGGEQDRDRSIRLVSGFLALAWDDLRSLCLFSYHRL

EESQNQQEKNEQDLLALDSWENLWNWFDITNWLWYIKIFIMIVGGLIGLRIIFAVLSIVNRVRQGYSPLSFQTLTPNPRGPDRLERIEEEGGEQDRDRSIRLVSGFLALAWDDLRSLCLFSYHRL gp140 ↑

RDFILVAARAVELLGRSSLRGLQRGWEALKYLGSLVQYWGLELKKSAISLLDTIAIAVAEGTDRIIELIQRICRAIRNIPRRIRQGFEAALQ 843

RDFILIAARTVELLGRSSLRGLQRGWEALKYLGSLVQYWGQELKKSAISLLDTIAIAVAEGTDRIIEVVQRACRAILNIPRRIRQGFEAALL 843

Fig. 13A

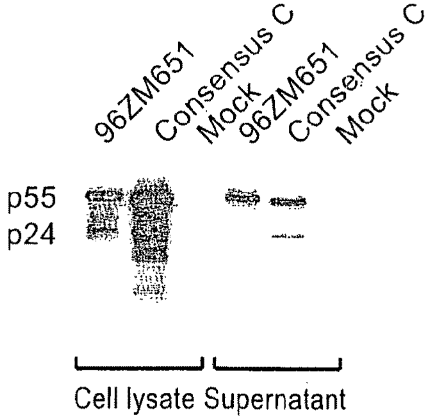

Fig. 13B

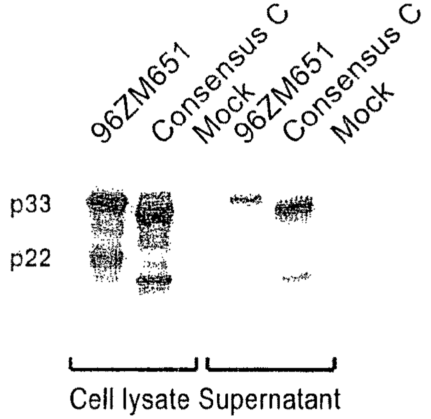

Fig. 13C

C.con.gag (subtype C con sensus gag)

MGARASILRGGKLDTWEKIRLRPGGKKRYMIKHLVWASRELERFALNPGLLETSEGCKQIMKQLQPA
LQTGTEELRSLYNTVATLYCVHEKIEVRDTKEALDKIEEEQNKSQQKTQQAEAAADGKVSQNYPI
VQNLQGQMVHQAISPRTLNAWVKVIEEKAFSPEVIPMFTALSEGATPQDLNTMLNTVGGHQAAMQMLKDT
INEEAAEWDRLHPVHAGPIAPGQMREPRGSDIAGTTSTL QEQIAWMTSNPPVPVGDIYKRWIILGLNKIV
RMYSPVSILDIKQGPKEPFRDYVDRFFKTLRAEQATQDVKNWMTDTLLVQNANPDCKTILRALGPGASLE
EMMTACQGVGGPSHKARVLAEAMSQANNTNIMMQRSNFKGPKRIVKCFNCGKEGHIARNCRAPRKKGCWK
CGKEGHQMKDCTERQANFLGKIWPSHKGRPGNFLQSRPEPTAPPAESFRFEETTPA
PKQEPKDREPLTSLKSLFGSDPLSQ

Fig. 13D

C.con.nef (subtype C consensus nef)

MGGKWSKSSIVGWPAVRERIRRTEPAAEGVGAASQDLDKYGALTSSNTATNNADCAWLEAQEEEEEV
GFPVRPQVPLRPMTYKAAFDLSFFLKEKGGLEGLIYSKKRQEILDLWVYHTQGFFPDWQNYTPGPGVRYP
LTFGWCFKLVPVDPREVEEANEGENNCLLHPMSQHGMEDEDREVLKWKFDSHLARRHMARELHPEYYKDC

Fig. 13E

C.con.gag (subtype C consensus gag. Not in the public domain)

GCCGCCGCCATGGGCGCCCGCGCCAGCATCCTGCGCGGCGGCAAGCTGGACACCTGGGAGAAGATCCGCC
TGCGCCCCGGCGGCAAGAAGCGCTACATGATCAAGCACCTGGTGTGGGCCAGCCGCGAGCTGGAGCGCTT
CGCCCTGAACCCCGGCCTGCTGGAGACCAGCGAGGGCTGCAAGCAGATCATGAAGCAGCTGCAGCCCGCC
CTGCAGACCGGCACCGAGGAGCTGCGCAGCCTGTACAACACCGTGGCCACCCTGTACTGCGTGCACGAGA
AGATCGAGGTGCGCGACACCAAGGAGGCCCTGGACAAGATCGAGGAGGAGCAGAACAAGAGCCAGCAGAA
GACCCAGCAGGCCGAGGCCGCCGCCGACGGCAAGGTGAGCCAGAACTACCCCATCGTGCAGAACCTGCAG
GGCCAGATGGTGCACCAGGCCATCAGCCCCCGCACCCTGAACGCCTGGGTGAAGGTGATCGAGGAGAAGG
CCTTCAGCCCCGAGGTGATCCCCATGTTCACCGCCCTGAGCGAGGGCGCCACCCCCCAGGACCTGAACAC
CATGCTGAACACCGTGGGCGGCCACCAGGCCGCCATGCAGATGCTGAAGGACACCATCAACGAGGAGGCC
GCCGAGTGGGACCGCCTGCACCCCGTGCACGCCGGCCCCATCGCCCCCGGCCAGATGCGCGAGCCCCGCG
GCAGCGACATCGCCGGCACCACCAGCACCCTGCAGGAGCAGATCGCCTGGATGACCAGCAACCCCCCCGT
GCCCGTGGGCGACATCTACAAGCGCTGGATCATCCTGGGCCTGAACAAGATCGTGCGCATGTACAGCCCC
GTGAGCATCCTGGACATCAAGCAGGGCCCCAAGGAGCCCTTCCGCGACTACGTGGACCGCTTCTTCAAGA
CCCTGCGCGCCGAGCAGGCCACCCAGGACGTGAAGAACTGGATGACCGACACCCTGCTGGTGCAGAACGC
CAACCCCGACTGCAAGACCATCCTGCGCGCCCTGGGCCCCGGCGCCAGCCTGGAGGAGATGATGACCGCC
TGCCAGGGCGTGGGCGGCCCCAGCCACAAGGCCCGCGTGCTGGCCGAGGCCATGAGCCAGGCCAACAACA
CCAACATCATGATGCAGCGCAGCAACTTCAAGGGCCCCAAGCGCATCGTGAAGTGCTTCAACTGCGGCAA
GGAGGGCCACATCGCCCGCAACTGCCGCGCCCCCCGCAAGAAGGGCTGCTGGAAGTGCGGCAAGGAGGGC
CACCAGATGAAGGACTGCACCGAGCGCCAGGCCAACTTCCTGGGCAAGATCTGGCCCAGCCACAAGGGCC
GCCCCGGCAACTTCCTGCAGAGCCGCCCCGAGCCCACCGCCCCCCCCGCCGAGAGCTTCCGCTTCGAGGA
GACCACCCCCGCCCCCAAGCAGGAGCCCAAGGACCGCGAGCCCCTGACCAGCCTGAAGAGCCTGTTCGGC
AGCGACCCCCTGAGCCAGTAA

Fig. 13F

C.con.nef (subtype C consensus nef. Not in the public domain)

GCCGCCGCCATGGGCGGCAAGTGGAGCAAGAGCAGCATCGTGGGCTGGCCCGCCGTGCGCGAGCGCATCC
GCCGCACCGAGCCCGCCGCCGAGGGCGTGGGCGCCGCCAGCCAGGACCTGGACAAGTACGGCGCCCTGAC
CAGCAGCAACACCGCCACCAACAACGCCGACTGCGCCTGGCTGGAGGCCCAGGAGGAGGAGGAGGAGGTG
GGCTTCCCCGTGCGCCCCCAGGTGCCCCTGCGCCCCATGACCTACAAGGCCGCCTTCGACCTGAGCTTCT
TCCTGAAGGAGAAGGGCGGCCTGGAGGGCCTGATCTACAGCAAGAAGCGCCAGGAGATCCTGGACCTGTG
GGTGTACCACACCCAGGGCTTCTTCCCCGACTGGCAGAACTACACCCCCGGCCCCGGCGTGCGCTACCCC
CTGACCTTCGGCTGGTGCTTCAAGCTGGTGCCCGTGGACCCCCGCGAGGTGGAGGAGGCCAACGAGGGCG
AGAACAACTGCCTGCTGCACCCCATGAGCCAGCACGGCATGGAGGACGAGGACCGCGAGGTGCTGAAGTG
GAAGTTCGACAGCCACCTGGCCCGCCGCCACATGGCCCGCGAGCTGCACCCCGAGTACTACAAGGACTGC
TGA

Fig. 14A

CONs.env (gorup M consensus env gene. This one contain the consensus sequence for variable regions in env gene)

MRVRGIQRNCQHLWRWGTLILGMLMICSAAENLWVTVYYGVPVWKEANTTLFCASDAKAYDTEVHNV
WATHACVPTDPNPQEIVLENVTENFNMWKNNMVEQMHEDIISLWDQSLKPCVKLTPLCVTLNCTNVNVTN
TTNNTEEKGEIKNCSFNITTEIRDKKQKVYALFYRLDVVPIDDNNNNSSNYRLINCNTSAITQACPKVSF
EPIPIHYCAPAGFAILKCNDKKFNGTGPCKNVSTVQCTHGIKPVVSTQLLLNGSLAEEEIIIRSENITNN
AKTIIVQLNESVEINCTRPNNNTRKSIRIGPGQAFYATGDIIGDIRQAHCNISGTKWNKTLQQVAKKLRE
HFNNKTIIFKPSSGGDLEITTHSFNCRGEFFYCNTSGLFNSTWIGNGTKNNNNTNDTITLPCRIKQIINM
WQGVGQAMYAPPIEGKITCKSNITGLLLTRDGGNNNTNETEIFRPGGGDMRDNWRSELYKYKVVKIEPLG
VAPTKAKRRVVEREKRAVGIGAVFLGFLGAAGSTMGAASITLTVQARQLLSGIVQQQSNLLRAIEAQQHL
LQLTVWGIKQLQARVLAVERYLKDQQLLGIWGCSGKLICTTTVPWNSSWSNKSQDEIWDNMTWMEWEREI
NNYTDIIYSLIEESQNQQEKNEQELLALDKWASLWNWFDITNWLWYIKIFIMIVGGLIGLRIVFAVLSIV
NRVRQGYSPLSFQTLIPNPRGPDRPEGIEEEGGEQDRDRSIRLVNGFLALAWDDLRSLCLFSYHRLRDFI
LIAARTVELLGRKGLRRGWEALKYLWNLLQYWGQELKNSAISLLDTTAIAVAEGTDRVIEVVQRACRAIL
NIPRRIRQGLERALL

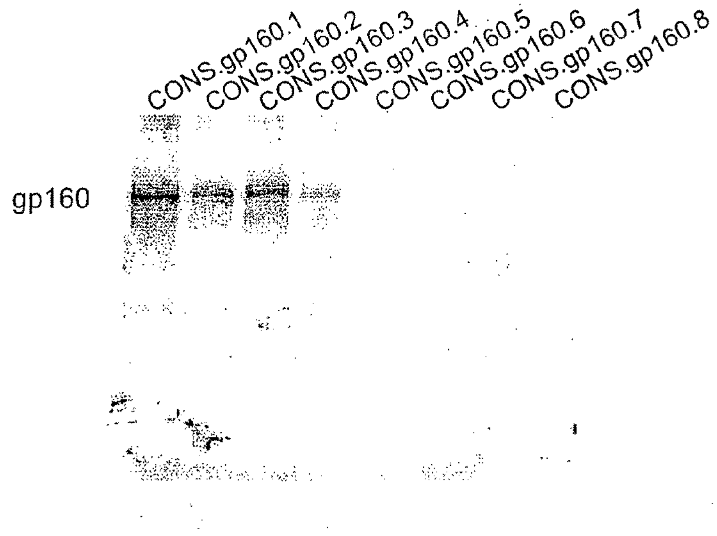

CONs.env (gorup M consensus env gene. This one contain the consensus sequence for variable regions in env gene. The identical amino acid sequences as in the public domain)

GCCGCCGCCATGCGCGTGCGCGGCATCCAGCGCAACTGCCAGCACCTGTG
GCGCTGGGGCACCCTGATCCTGGGCATGCTGATGATCTGCTCCGCCGCCG
AGAACCTGTGGGTGACCGTGTACTACGGCGTGCCCGTGTGGAAGGAGGCC
AACACCACCCTGTTCTGCGCCTCCGACGCCAAGGCCTACGACACCGAGGT
GCACAACGTGTGGGCCACCCACGCCTGCGTGCCCACCGACCCCAACCCCC
AGGAGATCGTGCTGGAGAACGTGACCGAGAACTTCAACATGTGGAAGAAC
AACATGGTGGAGCAGATGCACGAGGACATCATCTCCCTGTGGGACCAGTC
CCTGAAGCCCTGCGTGAAGCTGACCCCCCTGTGCGTGACCCTGAACTGCA
CCAACGTGAACGTGACCAACACCACCAACAACACCGAGGAGAAGGGCGAG
ATCAAGAACTGCTCCTTCAACATCACCACCGAGATCCGCGACAAGAAGCA
GAAGGTGTACGCCCTGTTCTACCGCCTGGACGTGGTGCCCATCGACGACA
ACAACAACAACTCCTCCAACTACCGCCTGATCAACTGCAACACCTCCGCC
ATCACCCAGGCCTGCCCCAAGGTGTCCTTCGAGCCCATCCCCATCCACTA
CTGCGCCCCCGCCGGCTTCGCCATCCTGAAGTGCAACGACAAGAAGTTCA
ACGGCACCGGCCCCTGCAAGAACGTGTCCACCGTGCAGTGCACCCACGGC
ATCAAGCCCGTGGTGTCCACCCAGCTGCTGCTGAACGGCTCCCTGGCCGA
GGAGGAGATCATCATCCGCTCCGAGAACATCACCAACAACGCCAAGACCA
TCATCGTGCAGCTGAACGAGTCCGTGGAGATCAACTGCACCCGCCCCAAC
AACAACACCCGCAAGTCCATCCGCATCGGCCCCGGCCAGGCCTTCTACGC
CACCGGCGACATCATCGGCGACATCCGCCAGGCCCACTGCAACATCTCCG
GCACCAAGTGGAACAAGACCCTGCAGCAGGTGGCCAAGAAGCTGCGCGAG
CACTTCAACAACAAGACCATCATCTTCAAGCCCTCCTCCGGCGGCGACCT
GGAGATCACCACCCACTCCTTCAACTGCCGCGGCGAGTTCTTCTACTGCA
ACACCTCCGGCCTGTTCAACTCCACCTGGATCGGCAACGGCACCAAGAAC
AACAACAACACCAACGACACCATCACCCTGCCCTGCCGCATCAAGCAGAT
CATCAACATGTGGCAGGGCGTGGGCCAGGCCATGTACGCCCCCCCCATCG
AGGGCAAGATCACCTGCAAGTCCAACATCACCGGCCTGCTGCTGACCCGC
GACGGCGGCAACAACAACACCAACGAGACCGAGATCTTCCGCCCCGGCGG
CGGCGACATGCGCGACAACTGGCGCTCCGAGCTGTACAAGTACAAGGTGG
TGAAGATCGAGCCCCTGGGCGTGGCCCCCACCAAGGCCAAGCGCCGCGTG
GTGGAGCGCGAGAAGCGCGCCGTGGGCATCGGCGCCGTGTTCCTGGGCTT
CCTGGGCGCCGCCGGCTCCACCATGGGCGCCGCCTCCATCACCCTGACCG
TGCAGGCCCGCCAGCTGCTGTCCGGCATCGTGCAGCAGCAGTCCAACCTG
CTGCGCGCCATCGAGGCCCAGCAGCACCTGCTGCAGCTGACCGTGTGGGG
CATCAAGCAGCTGCAGGCCCGCGTGCTGGCCGTGGAGCGCTACCTGAAGG
ACCAGCAGCTGCTGGGCATCTGGGGCTGCTCCGGCAAGCTGATCTGCACC
ACCACCGTGCCCTGGAACTCCTCCTGGTCCAACAAGTCCCAGGACGAGAT
CTGGGACAACATGACCTGGATGGAGTGGGAGCGCGAGATCAACAACTACA
CCGACATCATCTACTCCCTGATCGAGGAGTCCCAGAACCAGCAGGAGAAG
AACGAGCAGGAGCTGCTGGCCCTGGACAAGTGGGCCTCCCTGTGGAACTG
GTTCGACATCACCAACTGGCTGTGGTACATCAAGATCTTCATCATGATCG
TGGGCGGCCTGATCGGCCTGCGCATCGTGTTCGCCGTGCTGTCCATCGTG
AACCGCGTGCGCCAGGGCTACTCCCCCCTGTCCTTCCAGACCCTGATCCC
CAACCCCCGCGGCCCCGACCGCCCCGAGGGCATCGAGGAGGAGGGCGGCG
AGCAGGACCGCGACCGCTCCATCCGCCTGGTGAACGGCTTCCTGGCCCTG
GCCTGGGACGACCTGCGCTCCCTGTGCCTGTTCTCCTACCACCGCCTGCG
CGACTTCATCCTGATCGCCGCCCGCACCGTGGAGCTGCTGGGCCGCAAGG
GCCTGCGCCGCGGCTGGGAGGCCCTGAAGTACCTGTGGAACCTGCTGCAG
TACTGGGGCCAGGAGCTGAAGAACTCCGCCATCTCCCTGCTGGACACCAC
CGCCATCGCCGTGGCCGAGGGCACCGACCGCGTGATCGAGGTGGTGCAGC
GCGCCTGCCGCGCCATCCTGAACATCCCCCGCCGCATCCGCCAGGGCCTG
GAGCGCGCCCTGCTGTAA

Cell lysate Supernatant

Expression of A.con env gene in mammalian cells

Infectivity and coreceptor usage of CON6 and CONs *env* genes

Infectivity and coreceptor usage of CON6 and CONs *env* genes

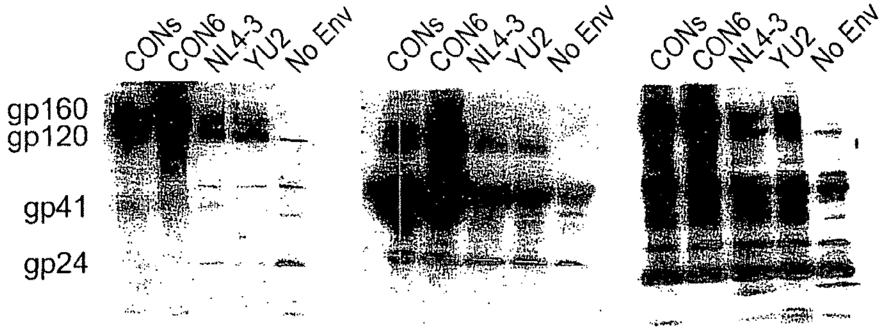

Lysate Supernatant Pellet

Env protein incorporation in CON6 and CONs Env-pseudovirions

A.con.env (subtype A consensus env)

MRVMGIQRNCQHLWRWGTMILGMIIICSAAENLWVTVYYGVPVWKDAETTLFCASDAKAYDTEVHNV
WATHACVPTDPNPQEINLENVTEEFNMWKNNMVEQMHTDIISLWDQSLKPCVKLTPLCVTLNCSNVNVTT
NITNITDNMKGEIKNCSFNMTTELRDKKQKVYSLFYKLDVVQINKSNSSSQYRLINCNTSAITQACPKVS
FEPIPIHYCAPAGFAILKCKDKEFNGTGPCKNVSTVQCTHGIKPVVSTQLLLNGSLAEEEVMIRSENITN
NAKNIIVQLTKPVKINCTRPNNNTRKSIRIGPGQAFYATGDIIGDIRQAHCNVSRTEWNETLQKVAKQLR
KYFNNKTIIFTNSSGGDLEITTHSFNCGGEFFYCNTSGLFNSTWNGNGTKKKNSTESNDTITLPC RIKQI
INMWQRVGQAMYAPPIQGVIRCESNITGLLLTRDGGDNNSKNETFRPGGGDMRDNWRSELYKYKVVKIEP
LGVAPTKAKRRVVEREKRAVGIGAVFLGFLGAAGSTMGAASITLTVQARQLLSGIVQQQSNLLRAIEAQQ
HLLKLTVWGIKQLQARVLAVERYLKDQQLLGIWGCSGKLICTTNVPWNSSWSNKSQSEIWDNMTWLQWDK
EISNYTDIIYNLIEESQNQQEKNEQDLLALDKWANLW NWFDISNWLWYIKIFIMIVGGLIGLRIVFAVLS
VINRVRQGYSPLSFQTHTPNPGGLDRPGRIEEEGGEQGRDRSIRLVSGFLALAWDDLRSLCLFSYHRLRD
FILIAARTVELLGHSSLKGLRLGWEGLKYLWNLLLYWGRELKISAINLLDTIAIAVAGWTDRVIEIGQRI
CRAILNIPRRIRQGLERALL

Fig. 18B

A.con.env (subtype A consensus env. Identical amino acid sequence to that in the public domain)

GCCGCCGCCATGCGCGTGATGGGCATCCAGCGCAACTGCCAGCACCTGTG
GCGCTGGGGCACCATGATCCTGGGCATGATCATCATCTGCTCCGCCGCCG
AGAACCTGTGGGTGACCGTGTACTACGGCGTGCCCGTGTGGAAGGACGCC
GAGACCACCCTGTTCTGCGCCTCCGACGCCAAGGCCTACGACACCGAGGT
GCACAACGTGTGGGCCACCCACGCCTGCGTGCCCACCGACCCCAACCCCC
AGGAGATCAACCTGGAGAACGTGACCGAGGAGTTCAACATGTGGAAGAAC
AACATGGTGGAGCAGATGCACACCGACATCATCTCCCTGTGGGACCAGTC
CCTGAAGCCCTGCGTGAAGCTGACCCCCCTGTGCGTGACCCTGAACTGCT
CCAACGTGAACGTGACCACCAACATCACCAACATCACCGACAACATGAAG
GGCGAGATCAAGAACTGCTCCTTCAACATGACCACCGAGCTGCGCGACAA
GAAGCAGAAGGTGTACTCCCTGTTCTACAAGCTGGACGTGGTGCAGATCA
ACAAGTCCAACTCCTCCTCCCAGTACCGCCTGATCAACTGCAACACCTCC
GCCATCACCCAGGCCTGCCCCAAGGTGTCCTTCGAGCCCATCCCCATCCA
CTACTGCGCCCCCGCCGGCTTCGCCATCCTGAAGTGCAAGGACAAGGAGT
TCAACGGCACCGGCCCCTGCAAGAACGTGTCCACCGTGCAGTGCACCCAC
GGCATCAAGCCCGTGGTGTCCACCCAGCTGCTGCTGAACGGCTCCCTGGC
CGAGGAGGAGGTGATGATCCGCTCCGAGAACATCACCAACAACGCCAAGA
ACATCATCGTGCAGCTGACCAAGCCCGTGAAGATCAACTGCACCCGCCCC
AACAACAACACCCGCAAGTCCATCCGCATCGGCCCCGGCCAGGCCTTCTA
CGCCACCGGCGACATCATCGGCGACATCCGCCAGGCCCACTGCAACGTGT
CCCGCACCGAGTGGAACGAGACCCTGCAGAAGGTGGCCAAGCAGCTGCGC
AAGTACTTCAACAACAAGACCATCATCTTCACCAACTCCTCCGGCGGCGA
CCTGGAGATCACCACCCACTCCTTCAACTGCGGCGGCGAGTTCTTCTACT
GCAACACCTCCGGCCTGTTCAACTCCACCTGGAACGGCAACGGCACCAAG
AAGAAGAACTCCACCGAGTCCAACGACACCATCACCCTGCCCTGCCGCAT
CAAGCAGATCATCAACATGTGGCAGCGCGTGGGCCAGGCCATGTACGCCC
CCCCCATCCAGGGCGTGATCCGCTGCGAGTCCAACATCACCGGCCTGCTG
CTGACCCGCGACGGCGGCGACAACAACTCCAAGAACGAGACCTTCCGCCC
CGGCGGCGGCGACATGCGCGACAACTGGCGCTCCGAGCTGTACAAGTACA
AGGTGGTGAAGATCGAGCCCCTGGGCGTGGCCCCCACCAAGGCCAAGCGC
CGCGTGGTGGAGCGCGAGAAGCGCGCCGTGGGCATCGGCGCCGTGTTCCT
GGGCTTCCTGGGCGCCGCCGGCTCCACCATGGGCGCCGCCTCCATCACCC
TGACCGTGCAGGCCCGCCAGCTGCTGTCCGGCATCGTGCAGCAGCAGTCC
AACCTGCTGCGCGCCATCGAGGCCCAGCAGCACCTGCTGAAGCTGACCGT
GTGGGGCATCAAGCAGCTGCAGGCCCGCGTGCTGGCCGTGGAGCGCTACC
TGAAGGACCAGCAGCTGCTGGGCATCTGGGGCTGCTCCGGCAAGCTGATC
TGCACCACCAACGTGCCCTGGAACTCCTCCTGGTCCAACAAGTCCCAGTC
CGAGATCTGGGACAACATGACCTGGCTGCAGTGGGACAAGGAGATCTCCA
ACTACACCGACATCATCTACAACCTGATCGAGGAGTCCCAGAACCAGCAG
GAGAAGAACGAGCAGGACCTGCTGGCCCTGGACAAGTGGGCCAACCTGTG
GAACTGGTTCGACATCTCCAACTGGCTGTGGTACATCAAGATCTTCATCA
TGATCGTGGGCGGCCTGATCGGCCTGCGCATCGTGTTCGCCGTGCTGTCC
GTGATCAACCGCGTGCGCCAGGGCTACTCCCCCCTGTCCTTCCAGACCCA
CACCCCCAACCCCGGCGGCCTGGACCGCCCCGGCCGCATCGAGGAGGAGG
GCGGCGAGCAGGGCCGCGACCGCTCCATCCGCCTGGTGTCCGGCTTCCTG
GCCCTGGCCTGGGACGACCTGCGCTCCCTGTGCCTGTTCTCCTACCACCG
CCTGCGCGACTTCATCCTGATCGCCGCCCGCACCGTGGAGCTGCTGGGCC
ACTCCTCCCTGAAGGGCCTGCGCCTGGGCTGGGAGGGCCTGAAGTACCTG
TGGAACCTGCTGCTGTACTGGGGCCGCGAGCTGAAGATCTCCGCCATCAA
CCTGCTGGACACCATCGCCATCGCCGTGGCCGGCTGGACCGACCGCGTGA
TCGAGATCGGCCAGCGCATCTGCCGCGCCATCCTGAACATCCCCCGCCGC
ATCCGCCAGGGCCTGGAGCGCGCCCTGCTGTAA

Fig. 18C

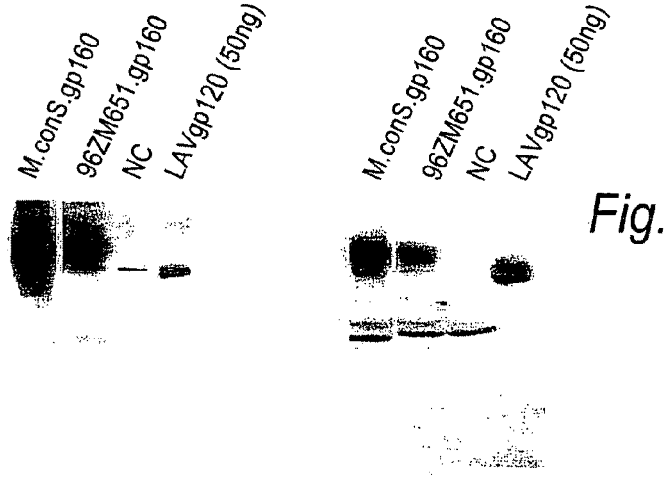

Fig. 18D

Cell lysate Supernatant

Expression of A.con env gene in mammalian cells

Fig. 19A

M.con.gag (group M consensus gag. Identical amino acid sequence to that in the public domain)

GCCGCCGCCATGGGCGCCCGCGCCTCCGTGCTGTCCGGCGGCAAGCTGGA
CGCCTGGGAGAAGATCCGCCTGCGCCCCGGCGGCAAGAAGAAGTACCGCC
TGAAGCACCTGGTGTGGGCCTCCCGCGAGCTGGAGCGCTTCGCCCTGAAC
CCCGGCCTGCTGGAGACCTCCGAGGGCTGCAAGCAGATCATCGGCCAGCT
GCAGCCCGCCCTGCAGACCGGCTCCGAGGAGCTGCGCTCCCTGTACAACA
CCGTGGCCACCCTGTACTGCGTGCACCAGCGCATCGAGGTGAAGGACACC
AAGGAGGCCCTGGAGAAGATCGAGGAGGAGCAGAACAAGTCCCAGCAGAA
GACCCAGCAGGCCGCCGCCGACAAGGGCAACTCCTCCAAGGTGTCCCAGA
ACTACCCCATCGTGCAGAACCTGCAGGGCCAGATGGTGCACCAGGCCATC
TCCCCCCGCACCCTGAACGCCTGGGTGAAGGTGATCGAGGAGAAGGCCTT
CTCCCCCGAGGTGATCCCCATGTTCTCCGCCCTGTCCGAGGGCGCCACCC
CCCAGGACCTGAACACCATGCTGAACACCGTGGGCGGCCACCAGGCCGCC
ATGCAGATGCTGAAGGACACCATCAACGAGGAGGCCGCCGAGTGGGACCG
CCTGCACCCCGTGCACGCCGGCCCCATCCCCCCCGGCCAGATGCGCGAGC
CCCGCGGCTCCGACATCGCCGGCACCACCTCCACCCTGCAGGAGCAGATC
GCCTGGATGACCTCCAACCCCCCCATCCCCGTGGGCGAGATCTACAAGCG
CTGGATCATCCTGGGCCTGAACAAGATCGTGCGCATGTACTCCCCCGTGT
CCATCCTGGACATCCGCCAGGGCCCCAAGGAGCCCTTCCGCGACTACGTG
GACCGCTTCTTCAAGACCCTGCGCGCCGAGCAGGCCACCCAGGACGTGAA
GAACTGGATGACCGACACCCTGCTGGTGCAGAACGCCAACCCCGACTGCA
AGACCATCCTGAAGGCCCTGGGCCCCGGCGCCACCCTGGAGGAGATGATG
ACCGCCTGCCAGGGCGTGGGCGGCCCCGGCCACAAGGCCCGCGTGCTGGC
CGAGGCCATGTCCCAGGTGACCAACGCCGCCATCATGATGCAGCGCGGCA
ACTTCAAGGGCCAGCGCCGCATCATCAAGTGCTTCAACTGCGGCAAGGAG
GGCCACATCGCCCGCAACTGCCGCGCCCCCCGCAAGAAGGGCTGCTGGAA
GTGCGGCAAGGAGGGCCACCAGATGAAGGACTGCACCGAGCGCCAGGCCA
ACTTCCTGGGCAAGATCTGGCCCTCCAACAAGGGCCGCCCCGGCAACTTC
CTGCAGTCCCGCCCCGAGCCCACCGCCCCCCCCGCCGAGTCCTTCGGCTT
CGGCGAGGAGATCACCCCCTCCCCCAAGCAGGAGCCCAAGGACAAGGAGC
CCCCCCTGACCTCCCTGAAGTCCCTGTTCGGCAACGACCCCCTGTCCCAG
TAA

M.con.pol.nuc

Fig. 19B

GCCGCCGCCATGCCCCAGATCACCCTGTGGCAGCGCCCCCTGGTGACCAT
CAAGATCGGCGGCCAGCTGAAGGAGGCCCTGCTGGCCACCGGCGCCGACG
ACACCGTGCTGGAGGAGATCAACCTGCCCGGCAAGTGGAAGCCCAAGATG
ATCGGCGGCATCGGCGGCTTCATCAAGGTGCGCCAGTACGACCAGATCCT
GATCGAGATCTGCGGCAAGAAGGCCATCGGCACCGTGCTGGTGGGCCCCA
CCCCCGTGAACATCATCGGCCGCAACATGCTGACCCAGATCGGCTGCACC
CTGAACTTCCCCATCTCCCCCATCGAGACCGTGCCCGTGAAGCTGAAGCC
CGGCATGGACGGCCCCAAGGTGAAGCAGTGGCCCCTGACCGAGGAGAAGA
TCAAGGCCCTGACCGAGATCTGCACCGAGATGGAGAAGGAGGGCAAGATC
TCCAAGATCGGCCCCGAGAACCCCTACAACACCCCCATCTTCGCCATCAA
GAAGAAGGACTCCACCAAGTGGCGCAAGCTGGTGGACTTCCGCGAGCTGA
ACAAGCGCACCCAGGACTTCTGGGAGGTGCAGCTGGGCATCCCCCACCCC
GCCGGCCTGAAGAAGAAGAAGTCCGTGACCGTGCTGGACGTGGGCGACGC
CTACTTCTCCGTGCCCCTGGACGAGGACTTCCGCAAGTACACCGCCTTCA
CCATCCCCTCCATCAACAACGAGACCCCCGGCATCCGCTACCAGTACAAC
GTGCTGCCCCAGGGCTGGAAGGGCTCCCCCGCCATCTTCCAGTCCTCCAT
GACCAAGATCCTGGAGCCCTTCCGCACCCAGAACCCCGAGATCGTGATCT
ACCAGTACATGGACGACCTGTACGTGGGCTCCGACCTGGAGATCGGCCAG
CACCGCGCCAAGATCGAGGAGCTGCGCGAGCACCTGCTGCGCTGGGGCTT
CACCACCCCCGACAAGAAGCACCAGAAGGAGCCCCCCTTCCTGTGGATGG
GCTACGAGCTGCACCCCGACAAGTGGACCGTGCAGCCCATCCAGCTGCCC
GAGAAGGACTCCTGGACCGTGAACGACATCCAGAAGCTGGTGGGCAAGCT
GAACTGGGCCTCCCAGATCTACCCCGGCATCAAGGTGAAGCAGCTGTGCA
AGCTGCTGCGCGGCGCCAAGGCCCTGACCGACATCGTGCCCCTGACCGAG
GAGGCCGAGCTGGAGCTGGCCGAGAACCGCGAGATCCTGAAGGAGCCCGT
GCACGGCGTGTACTACGACCCCTCCAAGGACCTGATCGCCGAGATCCAGA
AGCAGGGCCAGGACCAGTGGACCTACCAGATCTACCAGGAGCCCTTCAAG
AACCTCAAGACCGGCAAGTACGCCAAGATGCGCTCCGCCCACACCAACGA
CGTGAAGCAGCTGACCGAGGCCGTGCAGAAGATCGCCACCGAGTCCATCG
TGATCTGGGGCAAGACCCCCAAGTTCCGCCTGCCCATCCAGAAGGAGACC

TGGGAGACCTGGTGGACCGAGTACTGGCAGGCCACCTGGATTCCCGAGTG
GGAGTTCGTGAACACCCCCCCCCTGGTGAAGCTGTGGTACCAGCTGGAGA
AGGAGCCCATCGCCGGCGCCGAGACCTTCTACGTGGACGGCGCCGCCAAC
CGCGAGACCAAGCTGGGCAAGGCCGGCTACGTGACCGACCGCGGCCGCCA
GAAGGTGGTGTCCCTGACCGAGACCACCAACCAGAAAACCGAGCTGCAGG
CCATCCACCTGGCCCTGCAGGACTCCGGCTCCGAGGTGAACATCGTGACC
GACTCCCAGTACGCCCTGGGCATCATCCAGGCCCAGCCCGACAAGTCCGA
GTCCGAGCTGGTGAACCAGATCATCGAGCAGCTGATCAAGAAGGAGAAGG
TGTACCTGTCCTGGGTGCCCGCCCACAAGGGCATCGGCGGCAACGAGCAG
GTGGACAAGCTGGTGTCCACCGGCATCCGCAAGGTGCTGTTCCTGGACGG
CATCGACAAGGCCCAGGAGGAGCACGAGAAGTACCACTCCAACTGGCGCG
CCATGGCCTCCGACTTCAACCTGCCCCCCATCGTGGCCAAGGAGATCGTG
GCCTCCTGCGACAAGTGCCAGCTGAAGGGCGAGGCCATGCACGGCCAGGT
GGACTGCTCCCCCGGCATCTGGCAGCTGGACTGCACCCACCTGGAGGGCA
AGATCATCCTGGTGGCCGTGCACGTGGCCTCCGGCTACATCGAGGCCGAG
GTGATCCCCGCCGAGACCGGCCAGGAGACCGCCTACTTCATCCTGAAGCT
GGCCGGCCGCTGGCCCGTGAAGGTGATCCACACCGACAACGGCTCCAACT
TCACCTCCGCCGCCGTGAAGGCCGCCTGCTGGTGGGCCGGCATCCAGCAG
GAGTTCGGCATCCCCTACAACCCCCAGTCCCAGGGCGTGGTGGAGTCCAT
GAACAAGGAGCTGAAGAAGATCATCGGCCAGGTGCGCGACCAGGCCGAGC
ACCTCAAGACCGCCGTGCAGATGGCCGTGTTCATCCACAACTTCAAGCGC
AAGGGCGGCATCGGCGGCTACTCCGCCGGCGAGCGCATCATCGACATCAT
CGCCACCGACATCCAGACCAAGGAGCTGCAGAAGCAGATCACCAAGATCC
AGAACTTCCGCGTGTACTACCGCGACTCCCGCGACCCCATCTGGAAGGGC
CCCGCCAAGCTGCTGTGGAAGGGCGAGGGCGCCGTGGTGATCCAGGACAA
CTCCGACATCAAGGTGGTGCCCCGCCGCAAGGCCAAGATCATCCGCGACT
ACGGCAAGCAGATGGCCGGCGACGACTGCGTGGCCGGCCGCCAGGACGAG
GACTAA

Fig. 19C

M.con.nef (group M consensus nef. Identical amino acid sequence to that in the public domain)

GCCGCCGCCATGGGCGGCAAGTGGTCCAAGTCCTCCATCGTGGGCTGGCC
CGCCGTGCGCGAGCGCATCCGCCGCACCCACCCCGCCGCCGAGGGCGTGG
GCGCCGTGTCCCAGGACCTGGACAAGCACGGCGCCATCACCTCCTCCAAC
ACCGCCGCCAACAACCCCGACTGCGCCTGGCTGGAGGCCCAGGAGGAGGA
GGAGGAGGTGGGCTTCCCCGTGCGCCCCCAGGTGCCCCTGCGCCCCATGA
CCTACAAGGCCGCCCTGGACCTGTCCCACTTCCTGAAGGAGAAGGGCGGC
CTGGAGGGCCTGATCTACTCCAAGAAGCGCCAGGAGATCCTGGACCTGTG
GGTGTACCACACCCAGGGCTACTTCCCCGACTGGCAGAACTACACCCCCG
GCCCCGGCATCCGCTACCCCCTGACCTTCGGCTGGTGCTTCAAGCTGGTG
CCCGTGGACCCCGAGGAGGTGGAGGAGGCCAACGAGGGCGAGAACAACTC
CCTGCTGCACCCCATGTGCCAGCACGGCATGGAGGACGAGGAGCGCGAGG
TGCTGATGTGGAAGTTCGACTCCCGCCTGGCCCTGCGCCACATCGCCCGC
GAGCTGCACCCCGAGTACTACAAGGACTGCTAA

Fig. 19D

C.con.pol.nuc

GCCGCCGCCATGCCCCAGATCACCCTGTGGCAGCGCCCCCTGGTGTCCAT
CAAGGTGGGCGGCCAGATCAAGGAGGCCCTGCTGGCCACCGGCGCCGACG
ACACCGTGCTGGAGGAGATCAACCTGCCCGGCAAGTGGAAGCCCAAGATG
ATCGGCGGCATCGGCGGCTTCATCAAGGTGCGCCAGTACGACCAGATCCT
GATCGAGATCTGCGGCAAGAAGGCCATCGGCACCGTGCTGGTGGGCCCCA
CCCCCGTGAACATCATCGGCCGCAACATGCTGACCCAGCTGGGCTGCACC
CTGAACTTCCCCATCTCCCCCATCGAGACCGTGCCCGTGAAGCTGAAGCC
CGGCATGGACGGCCCCAAGGTGAAGCAGTGGCCCCTGACCGAGGAGAAGA
TCAAGGCCCTGACCGCCATCTGCGAGGAGATGGAGAAGGAGGGCAAGATC
ACCAAGATCGGCCCCGAGAACCCCTACAACACCCCCGTGTTCGCCATCAA
GAAGAAGGACTCCACCAAGTGGCGCAAGCTGGTGGACTTCCGCGAGCTGA
ACAAGCGCACCCAGGACTTCTGGGAGGTGCAGCTGGGCATCCCCCACCCC
GCCGGCCTGAAGAAGAAGAAGTCCGTGACCGTGCTGGACGTGGGCGACGC
CTACTTCTCCGTGCCCCTGGACGAGGGCTTCCGCAAGTACACCGCCTTCA
CCATCCCCTCCATCAACAACGAGACCCCCGGCATCCGCTACCAGTACAAC
GTGCTGCCCCAGGGCTGGAAGGGCTCCCCCGCCATCTTCCAGTCCTCCAT
GACCAAGATCCTGGAGCCCTTCCGCGCCCAGAACCCCGAGATCGTGATCT
ACCAGTACATGGACGACCTGTACGTGGGCTCCGACCTGGAGATCGGCCAG
CACCGCGCCAAGATCGAGGAGCTGCGCGAGCACCTGCTGAAGTGGGGCTT
CACCACCCCCGACAAGAAGCACCAGAAGGAGCCCCCCTTCCTGTGGATGG
GCTACGAGCTGCACCCCGACAAGTGGACCGTGCAGCCCATCCAGCTGCCC
GAGAAGGACTCCTGGACCGTGAACGACATCCAGAAGCTGGTGGGCAAGCT
GAACTGGGCCTCCCAGATCTACCCCGGCATCAAGGTGCGCCAGCTGTGCA
AGCTGCTGCGCGGCGCCAAGGCCCTGACCGACATCGTGCCCCTGACCGAG
GAGGCCGAGCTGGAGCTGGCCGAGAACCGCGAGATCCTGAAGGAGCCCGT
GCACGGCGTGTACTACGACCCCTCCAAGGACCTGATCGCCGAGATCCAGA
AGCAGGGCCACGACCAGTGGACCTACCAGATCTACCAGGAGCCCTTCAAG
AACCTCAAGACCGGCAAGTACGCCAAGATGCGCACCGCCCACACCAACGA
CGTGAAGCAGCTGACCGAGGCCGTGCAGAAGATCGCCATGGAGTCCATCG
TGATCTGGGGCAAGACCCCCAAGTTCCGCCTGCCCATCCAGAAGGAGACC
TGGGAGACCTGGTGGACCGACTACTGGCAGGCCACCTGGATTCCCGAGTG
GGAGTTCGTGAACACCCCCCCCCTGGTGAAGCTGTGGTACCAGCTGGAGA
AGGAGCCCATCGCCGGCGCCGAGACCTTCTACGTGGACGGCGCCGCCAAC

Fig. 19D (continued)

CGCGAGACCAAGATCGGCAAGGCCGGCTACGTGACCGACCGCGGCCGCCA
GAAGATCGTGTCCCTGACCGAGACCACCAACCAGAAAACCGAGCTGCAGG
CCATCCAGCTGGCCCTGCAGGACTCCGGCTCCGAGGTGAACATCGTGACC
GACTCCCAGTACGCCCTGGGCATCATCCAGGCCCAGCCCGACAAGTCCGA
GTCCGAGCTGGTGAACCAGATCATCGAGCAGCTGATCAAGAAGGAGCGCG
TGTACCTGTCCTGGGTGCCCGCCCACAAGGGCATCGGCGGCAACGAGCAG
GTGGACAAGCTGGTGTCCTCCGGCATCCGCAAGGTGCTGTTCCTGGACGG
CATCGACAAGGCCCAGGAGGAGCACGAGAAGTACCACTCCAACTGGCGCG
CCATGGCCTCCGAGTTCAACCTGCCCCCCATCGTGGCCAAGGAGATCGTG
GCCTCCTGCGACAAGTGCCAGCTGAAGGGCGAGGCCATGCACGGCCAGGT
GGACTGCTCCCCCGGCATCTGGCAGCTGGACTGCACCCACCTGGAGGGCA
AGATCATCCTGGTGGCCGTGCACGTGGCCTCCGGCTACATCGAGGCCGAG
GTGATCCCCGCCGAGACCGGCCAGGAGACCGCCTACTTCATCCTGAAGCT
GGCCGGCCGCTGGCCCGTGAAGGTGATCCACACCGACAACGGCTCCAACT
TCACCTCCGCCGCCGTGAAGGCCGCCTGCTGGTGGGCCGGCATCCAGCAG
GAGTTCGGCATCCCCTACAACCCCCAGTCCCAGGGCGTGGTGGAGTCCAT
GAACAAGGAGCTGAAGAAGATCATCGGCCAGGTGCGCGACCAGGCCGAGC
ACCTCAAGACCGCCGTGCAGATGGCCGTGTTCATCCACAACTTCAAGCGC
AAGGGCGGCATCGGCGGCTACTCCGCCGGCGAGCGCATCATCGACATCAT
CGCCACCGACATCCAGACCAAGGAGCTGCAGAAGCAGATCATCAAGATCC
AGAACTTCCGCGTGTACTACCGCGACTCCCGCGACCCCATCTGGAAGGGC
CCCGCCAAGCTGCTGTGGAAGGGCGAGGGCGCCGTGGTGATCCAGGACAA
CTCCGACATCAAGGTGGTGCCCCGCCGCAAGGCCAAGATCATCAAGGACT
ACGGCAAGCAGATGGCCGGCGCCGACTGCGTGGCCGGCCGCCAGGACGAG
GACTAA

Fig. 19E

M.con.gag (group M consensus gag)

MGARASVLSGGKLDAWEKIRLRPGGKKKYRLKHLVWASRELERFALNPGLLETSEG CKQIIGQLQPA
LQTGSEELRSLYNTVATLYCVHQRIEVKDTKEALEKIEEEQNKSQQKTQQAAADKGNSSKVSQNYPIVQN
LQGQMVHQAISPRTLNAWVKVIEEKAFSPEVIPMFSALSEGATPQDLNTMLNTVGGHQAAMQMLKDTINE
EAAEWDRLHPVHAGPIPPGQMREPRGSDIAGTTSTLQEQIAWMTSNPPIPVGEIYKRWIILGLNKIVRMY
SPVSILDIRQGPKEPFRDYVDRFFKTLRAEQATQDVKNWMTDTLLVQNANPDCKTILKALGPGATLEEMM
TACQGVGGPGHKARVLAEAMSQVTNAAIMMQRGNFKGQRRIIKCFNCGKEGHIARNCRAPRKKGCWKCGK
EGHQMKDCTERQANFLGKIWPSNKGRPGNFLQSRPEPTAPPAESFGFGEEITPSPKQEPKDKEPPLTSLK
SLFGNDPLSQ

*Fig. 19F*

M.con.pol (group M consensus pol)
MPQITLWQRPLVTIKIGGQLKEALLaTGADDTVLEEINLPGKWKPKMIGGIGGFIKVRQYDQILIEICGK
KAIGTVLVGPTPVNIIGRNMLTQIGCTLNFPISPIETVPVKLKPGMDGPKVKQWPLTEEKIKALTEICTE
MEKEGKISKIGPENPYNTPIFAIKKKDSTKWRKLVDFRELNKRTQDFWEVQLGIPHPAGLKKKKSVTVLD
VGDAYFSVPLDEDFRKYTAFTIPSINNETPGIRYQYNVLPQGWKGSPAIFQSSMTKILEPFRTQNPEIVI
YQYMDDLYVGSDLEIGQHRAKIEELREHLLRWGFTTPDKKHQKEPPFLWMGYELHPDKWTVQPIQLPEKD
SWTVNDIQKLVGKLNWASQIYPGIKVKQLCKLLRGAKALTDIVPLTEEAELELAENREILKEPVHGVYYD
PSKDLIAEIQKQGQDQWTYQIYQEPFKNLKTGKYAKMRSAHTNDVKQLTEAVQKIATESIVIWGKTPKFR
LPIQKETWETWWTEYWQATWIPEWEFVNTPPLVKLWYQLEKEPIAGAETFYVDGAANRETKLGKAGYVTD
RGRQKVVSLTETTNQKTELQAIHLALQDSGSEVNIVTDSQYALGIIQAQPDKSESELVNQIIEQLIKKEK
VYLSWVPAHKGIGGNEQVDKLVSTGIRKVLFLDGIDKAQEEHEKYHSNWRAMASDFNLPPIVAKEIVASC
DKCQLKGEAMHGQVDCSPGIWQLDCTHLEGKIILVAVHVASGYIEAEVIPAETGQETAYFILKLAGRWPV
KVIHTDNGSNFTSAAVKAACWWAGIQQEFGIPYNPQSQGVVESMNKELKKIIGQVRDQAEHLKTAVQMAV
FIHNFKRKGGIGGYSAGERIIDIIATDIQTKELQKQITKIQNFRVYYRDSRDPIWKGPAKLLWKGEGAVV
IQDNSDIKVVPRRKAKIIRDYGKQMAGDDCVAGRQDED

*Fig. 19G*

M.con.nef (group M consensus nef)
MGGKWSKSSIVGWPAVRERIRRTHPAAEGVGAVSQDLDKHGAITSSNTAANNPDCAWLEAQEEEEEVGFP
VRPQVPLRPMTYKAALDLSHFLKEKGGLEGLIYSKKRQEILDLWVYHTQGYFPDWQNYTPGPGIRYPLTF
GWCFKLVPVDPEEVEEANEGENNSLLHPMCQHGMEDEEREVLMWKFDSRLALRHIARELHPEYYKDC

*Fig. 19H*

C.con.pol (subtype C consensus pol)
MPQITLWQRPLVSIKVGGQIKEALLaTGADDTVLEEINLPGKWKPKMIGGIGGFIKVRQYDQILIEICGK
KAIGTVLVGPTPVNIIGRNMLTQLGCTLNFPISPIETVPVKLKPGMDGPKVKQWPLTEEKIKALTAICEE
MEKEGKITKIGPENPYNTPVFAIKKKDSTKWRKLVDFRELNKRTQDFWEVQLGIPHPAGLKKKKSVTVLD
VGDAYFSVPLDEGFRKYTAFTIPSINNETPGIRYQYNVLPQGWKGSPAIFQSSMTKILEPFRAQNPEIVI
YQYMDDLYVGSDLEIGQHRAKIEELREHLLKWGFTTPDKKHQKEPPFLWMGYELHPDKWTVQPIQLPEKD
SWTVNDIQKLVGKLNWASQIYPGIKVRQLCKLLRGAKALTDIVPLTEEAELELAENREILKEPVHGVYYD
PSKDLIAEIQKQGHDQWTYQIYQEPFKNLKTGKYAKMRTAHTNDVKQLTEAVQKIAMESIVIWGKTPKFR
LPIQKETWETWWTDYWQATWIPEWEFVNTPPLVKLWYQLEKEPIAGAETFYVDGAANRETKIGKAGYVTD
RGRQKIVSLTETTNQKTELQAIQLALQDSGSEVNIVTDSQYALGIIQAQPDKSESELVNQIIEQLIKKER
VYLSWVPAHKGIGGNEQVDKLVSSGIRKVLFLDGIDKAQEEHEKYHSNWRAMASEFNLPPIVAKEIVASC
DKCQLKGEAMHGQVDCSPGIWQLDCTHLEGKIILVAVHVASGYIEAEVIPAETGQETAYFILKLAGRWPV
KVIHTDNGSNFTSAAVKAACWWAGIQQEFGIPYNPQSQGVVESMNKELKKIIGQVRDQAEHLKTAVQMAV
FIHNFKRKGGIGGYSAGERIIDIIATDIQTKELQKQIIKIQNFRVYYRDSRDPIWKGPAKLLWKGEGAVV
IQDNSDIKVVPRRKAKIIKDYGKQMAGADCVAGRQDED

*Fig. 20A*

B.con.gag (subtype B consensus gag. The amino acid sequence is different from Los Alamos Database August 2002)

GCCGCCGCCATGGGCGCCCGCGCCTCCGTGCTGTCCGGCGGCGAGCTGGA
CCGCTGGGAGAAGATCCGCCTGCGCCCCGGCGGCAAGAAGAAGTACAAGC
TGAAGCACATCGTGTGGGCCTCCCGCGAGCTGGAGCGCTTCGCCGTGAAC
CCCGGCCTGCTGGAGACCTCCGAGGGCTGCCGCCAGATCCTGGGCCAGCT
GCAGCCCTCCCTGCAGACCGGCTCCGAGGAGCTGCGCTCCCTGTACAACA
CCGTGGCCACCCTGTACTGCGTGCACCAGCGCATCGAGGTGAAGGACACC
AAGGAGGCCCTGGAGAAGATCGAGGAGGAGCAGAACAAGTCCAAGAAGAA
GGCCCAGCAGGCCGCCGCCGACACCGGCAACTCCTCCCAGGTGTCCCAGA
ACTACCCCATCGTGCAGAACCTGCAGGGCCAGATGGTGCACCAGGCCATC
TCCCCCCGCACCCTGAACGCCTGGGTGAAGGTGGTGGAGGAGAAGGCCTT
CTCCCCCGAGGTGATCCCCATGTTCTCCGCCCTGTCCGAGGGCGCCACCC
CCCAGGACCTGAACACCATGCTGAACACCGTGGGCGGCCACCAGGCCGCC
ATGCAGATGCTGAAGGAGACCATCAACGAGGAGGCCGCCGAGTGGGACCG
CCTGCACCCCGTGCACGCCGGCCCCATCGCCCCCGGCCAGATGCGCGAGC
CCCGCGGCTCCGACATCGCCGGCACCACCTCCACCCTGCAGGAGCAGATC
GGCTGGATGACCAACAACCCCCCCATCCCCGTGGGCGAGATCTACAAGCG
CTGGATCATCCTGGGCCTGAACAAGATCGTGCGCATGTACTCCCCCACCT
CCATCCTGGACATCCGCCAGGGCCCCAAGGAGCCCTTCCGCGACTACGTG
GACCGCTTCTACAAGACCCTGCGCGCCGAGCAGGCCTCCCAGGAGGTGAA
GAACTGGATGACCGAGACCCTGCTGGTGCAGAACGCCAACCCCGACTGCA
AGACCATCCTGAAGGCCCTGGGCCCCGCCGCCACCCTGGAGGAGATGATG
ACCGCCTGCCAGGGCGTGGGCGGCCCCGGCCACAAGGCCCGCGTGCTGGC
CGAGGCCATGTCCCAGGTGACCAACTCCGCCACCATCATGATGCAGCGCG
GCAACTTCCGCAACCAGCGCAAGACCGTGAAGTGCTTCAACTGCGGCAAG
GAGGGCCACATCGCCAAGAACTGCCGCGCCCCCCGCAAGAAGGGCTGCTG
GAAGTGCGGCAAGGAGGGCCACCAGATGAAGGACTGCACCGAGCGCCAGG
CCAACTTCCTGGGCAAGATCTGGCCCTCCCACAAGGGCCGCCCCGGCAAC
TTCCTGCAGTCCCGCCCCGAGCCCACCGCCCCCCCCGAGGAGTCCTTCCG
CTTCGGCGAGGAGACCACCACCCCCTCCCAGAAGCAGGAGCCCATCGACA
AGGAGCTGTACCCCCTGGCCTCCCTGCGCTCCCTGTTCGGCAACGACCCC
TCCTCCCAGTAA

Fig. 20B

B.con.env (subtype B consensus env. The amino acid sequence is different from Los Alamos Database August 2002)

GCCGCCGCCATGCGCGTGAAGGGCATCCGCAAGAACTACCAGCACCTGTG
GCGCTGGGGCACCATGCTGCTGGGCATGCTGATGATCTGCTCCGCCGCCG
AGAAGCTGTGGGTGACCGTGTACTACGGCGTGCCCGTGTGGAAGGAGGCC
ACCACCACCCTGTTCTGCGCCTCCGACGCCAAGGCCTACGACACCGAGGT
GCACAACGTGTGGGCCACCCACGCCTGCGTGCCCACCGACCCCAACCCCC
AGGAGGTGGTGCTGGAGAACGTGACCGAGAACTTCAACATGTGGAAGAAC
AACATGGTGGAGCAGATGCACGAGGACATCATCTCCCTGTGGGACCAGTC
CCTGAAGCCCTGCGTGAAGCTGACCCCCCTGTGCGTGACCCTGAACTGCA
CCGACCTGAAGAACAACCTGCTGAACACCAACTCCTCCTCCGGCGAGAAG
ATGGAGAAGGGCGAGATCAAGAACTGCTCCTTCAACATCACCACCTCCAT
CCGCGACAAGGTGCAGAAGGAGTACGCCCTGTTCTACAAGCTGGACGTGG
TGCCCATCGACAACAACAACAACACCTCCTACCGCCTGATCTCCTGCAAC
ACCTCCGTGATCACCCAGGCCTGCCCCAAGGTGTCCTTCGAGCCCATCCC
CATCCACTACTGCGCCCCCGCCGGCTTCGCCATCCTGAAGTGCAACGACA
AGAAGTTCAACGGCACCGGCCCCTGCACCAACGTGTCCACCGTGCAGTGC
ACCCACGGCATCCGCCCCGTGGTGTCCACCCAGCTGCTGCTGAACGGCTC
CCTGGCCGAGGAGGAGGTGGTGATCCGCTCCGAGAACTTCACCGACAACG
CCAAGACCATCATCGTGCAGCTGAACGAGTCCGTGGAGATCAACTGCACC
CGCCCCAACAACAACACCCGCAAGTCCATCCACATCGGCCCCGGCCGCGC
CTTCTACACCACCGGCGAGATCATCGGCGACATCCGCCAGGCCCACTGCA
ACATCTCCCGCGCCAAGTGGAACAACACCCTGAAGCAGATCGTGAAGAAG
CTGCGCGAGCAGTTCGGCAACAAGACCATCGTGTTCAACCAGTCCTCCGG
CGGCGACCCCGAGATCGTGATGCACTCCTTCAACTGCGGCGGCGAGTTCT
TCTACTGCAACACCACCCAGCTGTTCAACTCCACCTGGAACGACAACGGC
ACCTGGAACAACACCAAGGACAAGAACACCATCACCCTGCCCTGCCGCAT
CAAGCAGATCATCAACATGTGGCAGGAGGTGGGCAAGGCCATGTACGCCC
CCCCCATCCGCGGCCAGATCCGCTGCTCCTCCAACATCACCGGCCTGCTG
CTGACCCGCGACGGCGGCAACAACAACAACGACACCGAGATCTTCCGCCC
CGGCGGCGGCGACATGCGCGACAACTGGCGCTCCGAGCTGTACAAGTACA
AGGTGGTGAAGATCGAGCCCCTGGGCGTGGCCCCCACCAAGGCCAAGCGC
CGCGTGGTGCAGCGCGAGAAGCGCGCCGTGGGCATCGGCGCCATGTTCCT
GGGCTTCCTGGGCGCCGCCGGCTCCACCATGGGCGCCGCCTCCATGACCC
TGACCGTGCAGGCCCGCCAGCTGCTGTCCGGCATCGTGCAGCAGCAGAAC
AACCTGCTGCGCGCCATCGAGGCCCAGCAGCACCTGCTGCAGCTGACCGT
GTGGGGCATCAAGCAGCTGCAGGCCCGCGTGCTGGCCGTGGAGCGCTACC
TGAAGGACCAGCAGCTGCTGGGCATCTGGGGCTGCTCCGGCAAGCTGATC
TGCACCACCACCGTGCCCTGGAACGCCTCCTGGTCCAACAAGTCCCTGGA
CGAGATCTGGGACAACATGACCTGGATGGAGTGGGAGCGCGAGATCGACA
ACTACACCTCCCTGATCTACACCCTGATCGAGGAGTCCCAGAACCAGCAG
GAGAAGAACGAGCAGGAGCTGCTGGAGCTGGACAAGTGGGCCTCCCTGTG
GAACTGGTTCGACATCACCAACTGGCTGTGGTACATCAAGATCTTCATCA
TGATCGTGGGCGGCCTGATCGGCCTGCGCATCGTGTTCGCCGTGCTGTCC
ATCGTGAACCGCGTGCGCCAGGGCTACTCCCCCCTGTCCTTCCAGACCCG
CCTGCCCGCCCCCCGCGGCCCCGACCGCCCCGAGGGCATCGAGGAGGAGG
GCGGCGAGCGCGACCGCGACCGCTCCGGCCGCCTGGTGGACGGCTTCCTG
GCCCTGATCTGGGACGACCTGCGCTCCCTGTGCCTGTTCTCCTACCACCG
CCTGCGCGACCTGCTGCTGATCGTGACCCGCATCGTGGAGCTGCTGGGCC
GCCGCGGCTGGGAGGTGCTGAAGTACTGGTGGAACCTGCTGCAGTACTGG
TCCCAGGAGCTGAAGAACTCCGCCGTGTCCCTGCTGAACGCCACCGCCAT
CGCCGTGGCCGAGGGCACCGACCGCGTGATCGAGGTGGTGCAGCGCGCCT
GCCGCGCCATCCTGCACATCCCCCGCCGCATCCGCCAGGGCCTGGAGCGC
GCCCTGCTGTAA

Fig. 20C

B.con.gag (subtype B consensus gag)

MGARASVLSGGELDRWEKIRLRPGGKKKYKLKHIVWASRELERFAVNPGLLETSEGCRQILGQLQPSLQT
GSEELRSLYNTVATLYCVHQRIEVKDTKEALEKIEEEQNKSKKKAQQAAADTGNSSQVSQNYPIVQNLQG
QMVHQAISPRTLNAWVKVVEEKAFSPEVIPMFSALSEGATPQDLNTMLNTVGGHQAAMQMLKETINEEAA
EWDRLHPVHAGPIAPGQMREPRGSDIAGTTSTLQEQIGWMTNNPPIPVGEIYKRWIILGLNKIV RMYSPT
SILDIRQGPKEPFRDYVDRFYKTLRAEQASQEVKNWMTETLLVQNANPDCKTILKALGPAATLEEMMTAC
QGVGGPGHKARVLAEAMSQVTNSATIMMQRGNFRNQRKTVKCFNCGKEGHIAKNCRAPRKKGCWKCGKEG
HQMKDCTERQANFLGKIWPSHKGRPGNFLQSRPEPTAPPEESFRFGEETTTPSQKQEPIDKELYPLASLR
SLFGNDPSSQ

Fig. 20D

B.con.env (subtype B consensus env)

MRVKGIRKNYQHLWRWGTMLLGMLMICSAAEKLWVTV YYGVPVWKEATTTLFCASDAKAYDTEVHNVWAT
HACVPTDPNPQEVVLENVTENFNMWKNNMVEQMHEDIISLWDQSLKPCVKLTPLCVTLNCTDLKNNLLNT
NSSSGEKMEKGEIKNCSFNITTSIRDKVQKEYALFYKLDVVPIDNNNNTSYRLISCNTSVITQACPKVSF
EPIPIHYCAPAGFAILKCNDKKFNGTGPCTNVSTVQCTHGIRPVVSTQLLLNGSLAEEEVVIRSENFTDN
AKTIIVQLNESVEINCTRPNNNTRKSIHIGPGRAFYTTGEIIGDIRQAHCNISRAKWNNTLKQIVKKLRE
QFGNKTIVFNQSSGGDPEIVMHSFNCGGEFFYCNTTQLFNSTWNDNGTWNNTKDKNTITLPCRIKQIINM
WQEVGKAMYAPPIRGQIRCSSNITGLLLTRDGGNNNNDTEIFRPGGGDMRDNWRSELYKYKVVKIEPLGV
APTKAKRRVVQREKRAVGIGAMFLGFLGAAGSTMGAASMTLTVQARQLLSGIVQQQNNLLRAIEAQQHLL
QLTVWGIKQLQARVLAVERYLKDQQLLGIWGCSGKLICTTTVPWNASWSNKSLDEIWDNMTWMEWEREID
NYTSLIYTLIEESQNQQEKNEQELLELDKWASLWNWFDITNWLWYIKIFIMIVGGLIGLRIVFAVLSIVN
RVRQGYSPLSFQTRLPAPRGPDRPEGIEEEGGERDRDRSGRLVDGFLALIWDDLRSLCLFSYHRLRDLLL
IVTRIVELLGRRGWEVLKYWWNLLQYWSQELKNSAVSLLNATAIAVAEGTDRVIEVVQRACRAILHIPRR
IRQGLERALL

Neutralization of Pseudovirions containing Subtype B consensus Env (gp160)

Neutralization of Pseudovirions containing NL4.3 Env (gp160)

Fig. 26A

Year 2000 Con-S 140CFI.Env

MRVRGIQRNCQHLWRWGTLILGMLMICSAAENLWVTVYYGVPVWKEANTTLFCASDAKAYDTEVH
NVWATHACVPTDPNPQEIVLENVTENFNMWKNNMVEQMHEDIISLWDQSLKPCVKLTPLCVTLNC
TNVNVTNTTNNTEEKGEIKNCSFNITTEIRDKKQKVYALFYRLDVVPIDDNNNNSSNYRLINCNT
SAITQACPKVSFEPIPIHYCAPAGFAILKCNDKKFNGTGPCKNVSTVQCTHGIKPVVSTQLLLNG
SLAEEEIIIRSENITNNAKTIIVQLNESVEINCTRPNNNTRKSIRIGPGQAFYATGDIIGDIRQA
HCNISGTKWNKTLQQVAKKLREHFNNKTIIFKPSSGGDLEITTHSFNCRGEFFYCNTSGLFNSTW
IGNGTKNNNNTNDTITLPCRIKQIINMWQGVGQAMYAPPIEGKITCKSNITGLLLTRDGGNNNTN
ETEIFRPGGGDMRDNWRSELYKYKVVKIEPLGVAPTKAKLTVQARQLLSGIVQQQSNLLRAIEAQ
QHLLQLTVWGIKQLQARVLAVERYLKDQQLEIWDNMTWMEWEREINNYTDIIYSLIEESQNQQEK
NEQELLALDKWASLWNWFDITNWLW

A gp140 CFI is referred to HIV-1 envelope design with the cleavage-site-deleted (C), fusion-site-deleted (F) and gp41 immunodominant region-deleted (I) in addition to the deletion of transmembrane and cytoplasmic domains.

Fig. 26B

Codon-optimized Year 2000 Con-S 140CFI. seq

ATGCGCGTGCGCGGCATCCAGCGCAACTGCCAGCACCTGTGGCGCTGGGGCACCCTGATCCTGGG
CATGCTGATGATCTGCTCCGCCGCCGAGAACCTGTGGGTGACCGTGTACTACGGCGTGCCCGTGT
GGAAGGAGGCCAACACCACCCTGTTCTGCGCCTCCGACGCCAAGGCCTACGACACCGAGGTGCAC
AACGTGTGGGCCACCCACGCCTGCGTGCCCACCGACCCCAACCCCCAGGAGATCGTGCTGGAGAA
CGTGACCGAGAACTTCAACATGTGGAAGAACAACATGGTGGAGCAGATGCACGAGGACATCATCT
CCCTGTGGGACCAGTCCCTGAAGCCCTGCGTGAAGCTGACCCCCCTGTGCGTGACCCTGAACTGC
ACCAACGTGAACGTGACCAACACCACCAACAACACCGAGGAGAAGGGCGAGATCAAGAACTGCTC
CTTCAACATCACCACCGAGATCCGCGACAAGAAGCAGAAGGTGTACGCCCTGTTCTACCGCCTGG
ACGTGGTGCCCATCGACGACAACAACAACAACTCCTCCAACTACCGCCTGATCAACTGCAACACC
TCCGCCATCACCCAGGCCTGCCCCAAGGTGTCCTTCGAGCCCATCCCCATCCACTACTGCGCCCC
CGCCGGCTTCGCCATCCTGAAGTGCAACGACAAGAAGTTCAACGGCACCGGCCCCTGCAAGAACG
TGTCCACCGTGCAGTGCACCCACGGCATCAAGCCCGTGGTGTCCACCCAGCTGCTGCTGAACGGC
TCCCTGGCCGAGGAGGAGATCATCATCCGCTCCGAGAACATCACCAACAACGCCAAGACCATCAT
CGTGCAGCTGAACGAGTCCGTGGAGATCAACTGCACCCGCCCCAACAACAACACCCGCAAGTCCA
TCCGCATCGGCCCCGGCCAGGCCTTCTACGCCACCGGCGACATCATCGGCGACATCCGCCAGGCC
CACTGCAACATCTCCGGCACCAAGTGGAACAAGACCCTGCAGCAGGTGGCCAAGAAGCTGCGCGA
GCACTTCAACAACAAGACCATCATCTTCAAGCCCTCCTCCGGCGGCGACCTGGAGATCACCACCC
ACTCCTTCAACTGCCGCGGCGAGTTCTTCTACTGCAACACCTCCGGCCTGTTCAACTCCACCTGG
ATCGGCAACGGCACCAAGAACAACAACAACACCAACGACACCATCACCCTGCCCTGCCGCATCAA
GCAGATCATCAACATGTGGCAGGGCGTGGGCCAGGCCATGTACGCCCCCCCCATCGAGGGCAAGA
TCACCTGCAAGTCCAACATCACCGGCCTGCTGCTGACCCGCGACGGCGGCAACAACAACACCAAC
GAGACCGAGATCTTCCGCCCCGGCGGCGGCGACATGCGCGACAACTGGCGCTCCGAGCTGTACAA
GTACAAGGTGGTGAAGATCGAGCCCCTGGGCGTGGCCCCCACCAAGGCCAAGCTTACCGTGCAGG
CCCGCCAGCTGCTGTCCGGCATCGTGCAGCAGCAGTCCAACCTGCTGCGCGCCATCGAGGCCCAG
CAGCACCTGCTGCAGCTGACCGTGTGGGGCATCAAGCAGCTGCAGGCCCGCGTGCTGGCCGTGGA
GCGCTACCTGAAGGACCAGCAGCTCGAGATCTGGGACAACATGACCTGGATGGAGTGGGAGCGCG
AGATCAACAACTACACCGACATCATCTACTCCCTGATCGAGGAGTCCCAGAACCAGCAGGAGAAG
AACGAGCAGGAGCTGCTGGCCCTGGACAAGTGGGCCTCCCTGTGGAACTGGTTCGACATCACCAA
CTGGCTGTGGTGAGGATCC

Fig. 28A

Design of expression-optimized HIV-1 envelope gp140CF

Con-B-2003 Env.pep (841 a.a.)*

MRVKGIRKNYQHLWRWGTMLLGMLMICSAAEKLWVTVYYGVPVWKEATTTLFCASDAKAYDTEVHNVWATHACVPTDPNPQEVVL
ENVTENFNMWKNNMVEQMHEDIISLWDQSLKPCVKLTPLCVTLNCTDLMNATNTNTTIIYRWRGEIKNCSFNITTSIRDKVQKEY
ALFYKLDVVPIDNDNTSYRLISCNTSVITQACPKVSFEPIPIHYCAPAGFAILKCNDKKFNGTGPCTNVSTVQCTHGIRPVVSTQ
LLLNGSLAEEEVVIRSENFTDNAKTIIVQLNESVEINCTRPNNNTRKSIHIGPGRAFYTTGEIIGDIRQAHCNISRAKWNNTLKQ
IVKKLREQFGNKTIVFNQSSGGDPEIVMHSFNCGGEFFYCNTTQLFNSTWNGTWNNTEGNITLPCRIKQIINMWQEVGKAMYAPP
IRGQIRCSSNITGLLLTRDGGNNETEIFRPGGGDMRDNWRSELYKYKVVKIEPLGVAPTKAKRRVVQREKRAVGIGAMFLGFLGA
AGSTMGAASMTLTVQARQLLSGIVQQQNNLLRAIEAQQHLLQLTVWGIKQLQARVLAVERYLKDQQLLGIWGCSGKLICTTAVPW
NASWSNKSLDEIWDNMTWMEWEREIDNYTSLIYTLIEESQNQQEKNEQELLELDKWASLWNWFDITNWLWYIKIFIMIVGGLVGL
RIVFAVLSIVNRVRQGYSPLSFQTRLPAPRGPDRPEGIEEEGGERDRDRSGRLVDGFLALIWDDLRSLCLFSYHRLRDLLLIVTR
IVELLGRRGWEVLKYWWNLLQYWSQELKNSAVSLLNATAIAVAEGTDRVIEVVQRACRAILHIPRRIRQGLERALL

*Amino acid sequence underlined is the fusion domain that will be deleted in 140CF design and the "W" underlined with red color is the last amino acid at the C terminus, and all the remaining amino acids after the "W" will be deleted in 140CF design.

Fig. 28B

Con-B-140CF.pep (632 a.a.)

Nick name: 002

MRVKGIRKNYQHLWRWGTMLLGMLMICSAAEKLWVTVYYGVPVWKEATTTLFCASDAKAYDTEVHNVWATHACVPTDPNPQEVVL
ENVTENFNMWKNNMVEQMHEDIISLWDQSLKPCVKLTPLCVTLNCTDLMNATNTNTTIIYRWRGEIKNCSFNITTSIRDKVQKEY
ALFYKLDVVPIDNDNTSYRLISCNTSVITQACPKVSFEPIPIHYCAPAGFAILKCNDKKFNGTGPCTNVSTVQCTHGIRPVVSTQ
LLLNGSLAEEEVVIRSENFTDNAKTIIVQLNESVEINCTRPNNNTRKSIHIGPGRAFYTTGEIIGDIRQAHCNISRAKWNNTLKQ
IVKKLREQFGNKTIVFNQSSGGDPEIVMHSFNCGGEFFYCNTTQLFNSTWNGTWNNTEGNITLPCRIKQIINMWQEVGKAMYAPP
IRGQIRCSSNITGLLLTRDGGNNETEIFRPGGGDMRDNWRSELYKYKVVKIEPLGVAPTKAKTLTVQARQLLSGIVQQQNNLLRA
IEAQQHLLQLTVWGIKQLQARVLAVERYLKDQQLLGIWGCSGKLICTTAVPWNASWSNKSLDEIWDNMTWMEWEREIDNYTSLIY
TLIEESQNQQEKNEQELLELDKWASLWNWFDITNWLW*

*Amino acids seen in blue color is for easy identification of the junction of the deleted fusion cleavage site.

Fig. 28C

Codon-opitmized Con-B 140CF.seq (1927 nt.)

Nick name: 002

TTCAGTCGACGGCCACCATGAGGGTGAAGGGTATTCGGAAAAATTACCAACACCTGTGGCGCTGGGGAACCATGCTCCTTGGTAT
GCTGATGATTTGCAGTGCCGCCGAGAAACTTTGGGTAACTGTGTACTACGGCGTTCCTGTCTGGAAGGAAGCTACAACCACTCTT
TTTTGTGCATCCGACGCTAAAGCTTACGACACAGAAGTGCATAATGTTTGGGCCACCCATGCTTGCGTCCCTACAGATCCCAACC
CCCAGGAAGTCGTCCTTGAGAATGTCACAGAGAATTTTAACATGTGGAAGAATAATATGGTAGAACAAATGCACGAAGACATTAT
TAGCCTGTGGGACCAGTCCTTGAAGCCCTGCGTGAAACTCACTCCACTTTGCGTCACACTTAACTGTACTGATTTGATGAACGCA
ACCAACACAAATACTACTATTATATATCGCTGGAGGGGGGAAATCAAGAACTGCTCTTTCAACATCACCACTTCCATAAGGGATA
AGGTCCAGAAAGAATATGCCCTGTTTTATAAACTTGATGTGGTCCCGATAGACAATGACAACACTAGCTATCGACTGATCTCTTG
TAACACATCCGTGATTACCCAAGCTTGCCCAAAGGTCAGCTTTGAACCAATACCCATTCACTACTGCGCTCCCGCTGGTTTTGCC
ATCCTCAAGTGTAACGACAAAAAATTCAATGGGACCGGACCTTGCACAAACGTGTCCACCGTGCAATGTACTCACGGAATCAGAC
CTGTTGTCAGTACCCAACTCCTCTTGAACGGGTCTCTCGCGGAAGAGGAGGTCGTGATTAGAAGCGAAAACTTTACCGATAACGC
TAAAACAATCATTGTGCAACTTAATGAAAGCGTCGAAATTAACTGCACCAGACCAAACAATAATACCAGAAAATCTATTCACATA
GGGCCCGGCCGCGCATTTTATACAACTGGCGAAATCATTGGTGACATCAGACAAGCTCATTGCAATATCTCCCGCGCGAAATGGA
ACAACACCCTGAAACAGATCGTGAAGAAACTTCGAGAACAATTCGGTAATAAAACAATCGTATTCAACCAAAGCTCCGGAGGCGA
CCCTGAGATAGTTATGCACTCATTCAACTGTGGCGGCGAGTTCTTCTATTGTAACACAACTCAACTTTTTAATAGCACTTGGAAT
GGAACATGGAACAACACAGAAGGGAACATCACTCTGCCTTGTCGGATTAAGCAGATCATTAATATGTGGCAAGAAGTGGGAAAAG
CTATGTACGCCCCGCCTATTCGCGGACAAATAAGATGCTCTAGTAATATTACCGGATTGTTGCTGACACGCGACGGAGGAAATAA
TGAAACAGAGATATTTAGACCTGGCGGAGGCGACATGAGAGATAACTGGAGAAGTGAGCTTTACAAATATAAAGTCGTAAAGATA
GAACCATTGGGGGTAGCACCAACCAAAGCAAAAACCTTGACAGTACAGGCTAGGCAGCTGCTGAGCGGAATCGTGCAACAACAAA
ATAATCTTCTCCGAGCCATAGAAGCACAACAACATCTGTTGCAGCTGACAGTATGGGGAATCAAACAGCTTCAGGCAAGAGTGCT
GGCCGTCGAGAGATACCTCAAAGATCAACAACTGCTGGGCATATGGGGATGTTCCGGTAAACTCATATGCACTACCGCCGTGCCC
TGGAACGCGAGCTGGTCTAATAAATCCCTGGATGAAATTTGGGACAACATGACTTGGATGGAATGGGAACGGGAAATTGACAACT
ATACTAGTTTGATTTATACTCTGATCGAAGAATCTCAGAACCAACAGGAGAAAAACGAACAGGAACTGCTGGAACTGGACAAGTG
GGCATCATTGTGGAACTGGTTTGACATTACTAACTGGCTGTGGTAAAGATCTTACAA

**(For all 140CF design shown here and below, 140CF gene will be flanked with the 5′ sequence of "TTCAGTCGACGGCCACC" that contains a Kozak" sequence (GCCACCATGG/A) and *SalI* site and 3′ sequence of TAAAGATCTTACAA containing stop codon and *BglII* site.)**

Fig. 29A

CON_OF_CON-S-2003 (829 a.a.)

MRVMGIQRNCQHLWRWGILIFGMLIICSAAENLWVTVYYGVPVWKEANTTLFCASDAKAYDTEVHNVWATHACVPTDPNPQEIVL
ENVTENFNMWKNNMVEQMHEDIISLWDQSLKPCVKLTPLCVTLNCTDVNATNNTTNNEEIKNCSFNITTEIRDKKKKVYALFYKL
DVVPIDDNNSYRLINCNTSAITQACPKVSFEPIPIHYCAPAGFAILKCNDKKFNGTGPCKNVSTVQCTHGIKPVVSTQLLLNGSL
AEEEIIIRSENITNNAKTIIVQLNESVEINCTRPNNNTRKSIRIGPGQAFYATGDIIGDIRQAHCNISRTKWNKTLQQVAKKLRE
HFNKTIIFNPSSGGDLEITTHSFNCGGEFFYCNTSELFNSTWNGTNNTITLPCRIKQIINMWQGVGQAMYAPPIEGKIRCTSNIT
GLLLTRDGGNNNTETFRPGGGDMRDNWRSELYKYKVVKIEPLGVAPTKAKRRVVEREKRAVGIGAVFLGFLGAAGSTMGAASITL
TVQARQLLSGIVQQQSNLLRAIEAQQHLLQLTVWGIKQLQARVLAVERYLKDQQLLGIWGCSGKLICTTNVPWNSSWSNKSQDEI
WDNMTWMEWDKEINNYTDIIYSLIEESQNQQEKNEQELLALDKWASLWNWFDITNWLWYIKIFIMIVGGLIGLRIVFAVLSIVNR
VRQGYSPLSFQTLIPNPRGPDRPEGIEEEGGEQDRDRSIRLVNGFLALAWDDLRSLCLFSYHRLRDLILIAARTVELLGRRGWEA
LKYLWNLLQYWGQELKNSAISLLDTTAIAVAEGTDRVIEVVQRVCRAILNIPRRIRQGFERALL

*Amino acid sequence underlined is the fusion domain that will be deleted in 140CF design and the "W" underlined with red color is the last amino acid at the C terminus, and all the remaining amino acids after the "W" will be deleted in 140CF design.

Fig. 29B

CON-S-2003 140CF.pep (620 a.a.).

Nick name: 006

MRVMGIQRNCQHLWRWGILIFGMLIICSAAENLWVTVYYGVPVWKEANTTLFCASDAKAYDTEVHNVWATHACVPTDPNPQEIVL
ENVTENFNMWKNNMVEQMHEDIISLWDQSLKPCVKLTPLCVTLNCTDVNATNNTTNNEEIKNCSFNITTEIRDKKKKVYALFYKL
DVVPIDDNNSYRLINCNTSAITQACPKVSFEPIPIHYCAPAGFAILKCNDKKFNGTGPCKNVSTVQCTHGIKPVVSTQLLLNGSL
AEEEIIIRSENITNNAKTIIVQLNESVEINCTRPNNNTRKSIRIGPGQAFYATGDIIGDIRQAHCNISRTKWNKTLQQVAKKLRE
HFNKTIIFNPSSGGDLEITTHSFNCGGEFFYCNTSELFNSTWNGTNNTITLPCRIKQIINMWQGVGQAMYAPPIEGKIRCTSNIT
GLLLTRDGGNNNTETFRPGGGDMRDNWRSELYKYKVVKIEPLGVAPTKAKTLTVQARQLLSGIVQQQSNLLRAIEAQQHLLQLTV
WGIKQLQARVLAVERYLKDQQLLGIWGCSGKLICTTNVPWNSSWSNKSQDEIWDNMTWMEWDKEINNYTDIIYSLIEESQNQQEK
NEQELLALDKWASLWNWFDITNWLW*

*Amino acids seen in blue color is for easy identification of the junction of the deleted fusion cleavage site.

Fig. 29C

CODON-OPTIMIZED CON-S-2003 140CF.seq (1891 nt

Nick name :006

TTCAGTCGACAGCCACCATGCGGGTCATGGGGATACAGAGGAATTGCCAGCACTTGTGGAGGTGGGGAATTTTGATATTCGGAT
GCTCATAATCTGCTCTGCCGCTGAGAACCTGTGGGTCACTGTGTATTACGGCGTTCCCGTCTGGAAAGAAGCTAATACTACCCTG
TTTTGTGCAAGCGACGCCAAAGCATACGACACCGAAGTCCACAATGTCTGGGCTACCCACGCCTGTGTACCTACTGATCCAAATC
CCCAGGAAATTGTTCTTGAAAACGTAACGGAAAACTTTAACATGTGGAAGAATAATATGGTGGAGCAAATGCACGAGGATATAAT
CAGCCTGTGGGACCAGTCCCTCAAACCATGCGTTAAACTCACTCCACTCTGCGTGACTCTGAACTGTACCGACGTGAACGCAACC
AATAATACAACAAACAATGAGGAGATAAAGAATTGTTCATTTAATATAACCACTGAGATACGGGATAAGAAAAAAAAGGTTTATG
CACTCTTTTACAAGCTCGACGTGGTGCCCATAGACGACAATAATAGCTACCGACTCATTAATTGCAATACTAGCGCTATAACCCA
GGCATGCCCCAAAGTTTCCTTCGAGCCCATACCGATTCACTACTGCGCACCCGCCGGATTCGCCATTCTTAAATGCAATGACAAG
AAGTTCAACGGCACCGGACCCTGTAAGAACGTAAGCACTGTTCAATGTACACATGGAATTAAGCCGGTAGTGTCAACGCAGCTCC
TCCTCAACGGAAGCCTTGCAGAAGAAGAGATCATTATCAGGTCAGAAAATATCACTAACAACGCGAAAACAATCATTGTTCAGCT
GAATGAGTCTGTAGAAATCAATTGTACCCGCCCTAATAATAACACAAGAAAGTCAATTAGGATCGGACCCGGCCAGGCTTTCTAC
GCAACCGGAGATATCATCGGGGATATACGACAGGCCCACTGCAACATTTCTAGAACTAAGTGGAATAAAACTTTGCAGCAGGTAG
CCAAGAAACTGCGGGAACATTTTAATAAGACAATCATCTTCAATCCAAGTAGCGGAGGGGACCTGGAAATCACTACACATTCCTT
TAACTGTGGGGGCGAGTTTTTCTACTGTAATACCTCTGAACTGTTCAACTCAACATGGAATGGCACTAACAATACTATAACTCTT
CCTTGCAGAATAAAACAGATTATCAACATGTGGCAGGGTGTGGGGCAAGCAATGTATGCACCACCAATCGAAGGCAAAATAAGAT
GCACCTCCAATATTACCGGACTCCTCCTGACACGGGATGGCGGAAACAATAACACGGAGACCTTTAGGCCAGGCGGCGGCGATAT
GAGAGATAACTGGCGCTCCGAGCTCTATAAATACAAAGTCGTTAAGATCGAGCCCCTTGGAGTTGCGCCAACCAAAGCTAAAACC
TTGACCGTGCAAGCCAGGCAGTTGTTGTCAGGTATCGTACAGCAGCAATCTAATCTTTTGAGAGCCATTGAGGCTCAGCAGCACC
TCTTGCAGCTTACCGTCTGGGGCATCAAACAACTTCAGGCACGCGTCCTGGCCGTAGAGCGCTATTTGAAAGACCAACAACTTCT
CGGGATCTGGGGGTGTTCTGGAAAATTGATCTGCACGACAAATGTGCCTTGGAACAGCAGCTGGTCAAATAAAAGCCAAGACGAA
ATATGGGATAACATGACATGGATGGAATGGGATAAAGAAATTAATAATTACACTGACATTATTTACTCACTTATCGAGGAATCAC
AAAATCAACAGGAAAAAAATGAACAGGAACTCTTGGCTCTGGACAAATGGGCTTCACTGTGGAACTGGTTCGACATCACAAATTG
GCTCTGGTAAAGATCTTACAA

Fig. 30A

CONSENSUS_A1-2003(845 a.a.)

MRVMGIQRNCQHLLRWGTMILGMIIICSAAENLWVTVYYGVPVWKDAETTLFCASDAKAYETEMHNVWATHACVPTDPNPQEIHL
ENVTEEFNMWKNNMVEQMHTDIISLWDQSLKPCVKLTPLCVTLNCSNVNVTNNTTNTHEEEIKNCSFNMTTELRDKKQKVYSLFY
RLDVVQINENNSNSSYRLINCNTSAITQACPKVSFEPIPIHYCAPAGFAILKCKDKEFNGTGPCKNVSTVQCTHGIKPVVSTQLL
LNGSLAEEEVIIRSENITNNAKTIIVQLTKPVKINCTRPNNNTRKSIRIGPGQAFYATGDIIGDIRQAHCNVSRSEWNKTLQKVA
KQLRKYFKNKTIIFTNSSGGDLEITTHSFNCGGEFFYCNTSGLFNSTWNNGTMKNTITLPCRIKQIINMWQRAGQAMYAPPIQGV
IRCESNITGLLLTRDGGNNNTNETFRPGGGDMRDNWRSELYKYKVVKIEPLGVAPTRAKRRVVEREKRAVGIGAVFLGFLGAAGS
TMGAASITLTVQARQLLSGIVQQQSNLLRAIEAQQHLLKLTVWGIKQLQARVLAVERYLKDQQLLGIWGCSGKLICTTNVPWNSS
WSNKSQNEIWDNMTWLQWDKEISNYTHIIYNLIEESQNQQEKNEQDLLALDKWANLWNWFDISNWLWYIKIFIMIVGGLIGLRIV
FAVLSVINRVRQGYSPLSFQTHTPNPRGLDRPGRIEEEGGEQGRDRSIRLVSGFLALAWDDLRSLCLFSYHRLRDFILIAARTVE
LLGHSSLKGLRLGWEGLKYLWNLLLYWGRELKISAINLVDTIAIAVAGWTDRVIEIGQRIGRAILHIPRRIRQGLERALL

*Amino acid sequence underlined is the fusion domain that will be deleted in 140CF design and the "W" underlined with red color is the last amino acid at the C terminus, and all the remaining amino acids after the "W" will be deleted in 140CF design.

Fig. 30B

Con-A1-2003 140CF.pep (629 a.a.)

Nick name: 001

MRVMGIQRNCQHLLRWGTMILGMIIICSAAENLWVTVYYGVPVWKDAETTLFCASDAKAYETEMHNVWATHACVPTDPNPQEIHL
ENVTEEFNMWKNNMVEQMHTDIISLWDQSLKPCVKLTPLCVTLNCSNVNVTNNTTNTHEEEIKNCSFNMTTELRDKKQKVYSLFY
RLDVVQINENNSNSSYRLINCNTSAITQACPKVSFEPIPIHYCAPAGFAILKCKDKEFNGTGPCKNVSTVQCTHGIKPVVSTQLL
LNGSLAEEEVIIRSENITNNAKTIIVQLTKPVKINCTRPNNNTRKSIRIGPGQAFYATGDIIGDIRQAHCNVSRSEWNKTLQKVA
KQLRKYFKNKTIIFTNSSGGDLEITTHSFNCGGEFFYCNTSGLFNSTWNNGTMKNTITLPCRIKQIINMWQRAGQAMYAPPIQGV
IRCESNITGLLLTRDGGNNNTNETFRPGGGDMRDNWRSELYKYKVVKIEPLGVAPTRAKTLTVQARQLLSGIVQQQSNLLRAIEA
QQHLLKLTVWGIKQLQARVLAVERYLKDQQLLGIWGCSGKLICTTNVPWNSSWSNKSQNEIWDNMTWLQWDKEISNYTHIIYNLI
EESQNQQEKNEQDLLALDKWANLWNWFDISNWLW*

*Amino acids seen in blue color is for easy identification of the junction of the deleted fusion cleavage site.

*Fig. 30C*

CODON-OPTIMIZED Con-A1-2003.seq

Nick name: 001 (1918 nt)

TTCAGTCGACAGCCACCATGAGGGTGATGGGAATCCAACGGAACTGCCAGCATCTTCTCCGGTGGGGAACGATGATACTGGGAAT
GATAATAATCTGCTCTGCCGCTGAAAACCTCTGGGTCACAGTGTACTACGGAGTGCCTGTATGGAAGGACGCTGAAACCACTCTC
TTTTGTGCTTCCGATGCTAAAGCCTACGAAACCGAGATGCACAATGTTTGGGCCACCCACGCCTGCGTGCCAACTGATCCTAATC
CACAAGAAATACATCTGGAGAATGTTACTGAGGAATTTAACATGTGGAAAAATAATATGGTAGAGCAAATGCACACTGACATCAT
TTCACTCTGGGACCAATCACTCAAACCCTGCGTTAAACTTACCCCCCTCTGCGTGACCCTCAATTGTAGCAACGTCAACGTCACA
AATAATACAACCAACACTCACGAGGAAGAAATTAAAAATTGCTCCTTTAATATGACCACTGAACTTCGCGACAAAAAACAAAAAG
TCTATTCACTGTTTTATAGGCTGGACGTCGTCCAAATCAACGAGAACAATTCTAACAGTAGCTATCGACTTATCAATTGCAATAC
CTCTGCTATTACCCAAGCTTGTCCTAAAGTCTCTTTTGAACCAATCCCTATCCACTACTGTGCCCCAGCTGGATTCGCAATTCTG
AAGTGCAAGGATAAGGAATTCAACGGAACTGGCCCTTGCAAGAACGTTAGCACTGTCCAATGCACTCACGGAATCAAACCAGTAG
TCAGCACTCAACTGCTCCTGAATGGCTCACTCGCCGAAGAAGAGGTGATTATCCGAAGCGAGAACATAACTAACAATGCGAAGAC
AATAATTGTTCAATTGACGAAACCAGTGAAGATCAACTGTACTAGACCAAATAACAACACAAGAAAATCTATCAGAATTGGCCCC
GGACAAGCCTTCTACGCAACAGGAGATATCATAGGTGACATCAGACAGGCCCATTGCAACGTTTCAAGAAGCGAGTGGAATAAAA
CACTCCAGAAAGTGGCAAAGCAGCTGAGAAAATACTTTAAGAACAAGACAATCATATTTACTAACTCCTCCGGAGGTGATCTCGA
AATAACCACTCATAGCTTTAATTGTGGGGGCGAATTCTTCTACTGTAACACATCTGGCCTCTTTAATTCTACCTGGAATAACGGC
ACCATGAAAAATACTATCACCCTCCCTTGCAGAATTAAGCAAATCATTAACATGTGGCAGAGAGCAGGACAGGCCATGTATGCCC
CTCCCATTCAAGGTGTGATTCGATGTGAAAGCAACATTACTGGACTTCTTCTGACCCGGGATGGCGGAAATAATAATACCAATGA
GACATTCAGACCCGGCGGCGGCGATATGCGAGACAATTGGCGAAGTGAACTTTATAAATACAAAGTAGTTAAGATTGAGCCCCTT
GGAGTTGCCCCTACTAGAGCAAAAACATTGACCGTTCAGGCCAGGCAGCTGCTCTCAGGAATCGTGCAGCAGCAAAGTAACCTCC
TCCGAGCTATCGAGGCACAACAACATCTCTTGAAATTGACCGTATGGGGAATCAAGCAATTGCAGGCTAGGGTTTTGGCTGTGGA
ACGCTATCTCAAGGATCAGCAGCTTCTGGGAATCTGGGGATGCTCTGGGAAATTGATATGTACTACAAACGTACCCTGGAACTCA
AGCTGGAGTAATAAAAGCCAGAACGAAATTTGGGATAATATGACCTGGCTGCAGTGGGACAAAGAAATTTCTAATTATACTCATA
TCATATACAATCTGATCGAAGAATCACAGAACCAGCAGGAAAAGAATGAGCAAGACCTTCTGGCCTTGGACAAGTGGGCTAACTT
GTGGAACTGGTTTGACATTAGCAACTGGCTGTGGTAAAGATCTTACAA

*Fig. 31A*

CONSENSUS_C-2003 (835 a.a)

MRVRGILRNCQQWWIWGILGFWMLMICNVVGNLWVTVYYGVPVWKEAKTTLFCASDAKAYEKEVHNVWATHACVPTDPNPQEIVL
ENVTENFNMWKNDMVDQMHEDIISLWDQSLKPCVKLTPLCVTLNCTNATNATNTMGEIKNCSFNITTELRDKKQKVYALFYRLDI
VPLNENNSYRLINCNTSAITQACPKVSFDPIPIHYCAPAGYAILKCNNKTFNGTGPCNNVSTVQCTHGIKPVVSTQLLLNGSLAE
EEIIIRSENLTNNAKTIIVHLNESVEIVCTRPNNNTRKSIRIGPGQTFYATGDIIGDIRQAHCNISEDKWNKTLQKVSKKLKEHF
PNKTIKFEPSSGGDLEITTHSFNCRGEFFYCNTSKLFNSTYNSTNSTITLPCRIKQIINMWQEVGRAMYAPPIAGNITCKSNITG
LLLTRDGGKNNTETFRPGGGDMRDNWRSELYKYKVVEIKPLGIAPTKAKRRVVEREKRAVGIGAVFLGFLGAAGSTMGAASITLT
VQARQLLSGIVQQQSNLLRAIEAQQHMLQLTVWGIKQLQTRVLAIERYLKDQQLLGIWGCSGKLICTTAVPWNSSWSNKSQEDIW
DNMTWMQWDREISNYTDTIYRLLEDSQNQQEKNEKDLLALDSWKNLWNWFDITNWLWYIKIFIMIVGGLIGLRIIFAVLSIVNRV
RQGYSPLSFQTLTPNPRGPDRLGRIEEEGGEQDRDRSIRLVSGFLALAWDDLRSLCLFSYHRLRDFILIAARAVELLGRSSLRGL
QRGWEALKYLGSLVQYWGLELKKSAISLLDTIAIAVAEGTDRIIELIQRICRAIRNIPRRIRQGFEAALQ

*Amino acid sequence underlined is the fusion domain that will be deleted in 140CF design and the "W" underlined with red color is the last amino acid at the C terminus, and all the remaining amino acids after the "W" will be deleted in 140CF design..

*Fig. 31B*

Con-C 2003 140CF.pep (619 a.a.)

Nick name: 003

MRVRGILRNCQQWWIWGILGFWMLMICNVVGNLWVTVYYGVPVWKEAKTTLFCASDAKAYEKEVHNVWATHACVPTDPNPQEIVL
ENVTENFNMWKNDMVDQMHEDIISLWDQSLKPCVKLTPLCVTLNCTNATNATNTMGEIKNCSFNITTELRDKKQKVYALFYRLDI
VPLNENNSYRLINCNTSAITQACPKVSFDPIPIHYCAPAGYAILKCNNKTFNGTGPCNNVSTVQCTHGIKPVVSTQLLLNGSLAE
EEIIIRSENLTNNAKTIIVHLNESVEIVCTRPNNNTRKSIRIGPGQTFYATGDIIGDIRQAHCNISEDKWNKTLQKVSKKLKEHF
PNKTIKFEPSSGGDLEITTHSFNCRGEFFYCNTSKLFNSTYNSTNSTITLPCRIKQIINMWQEVGRAMYAPPIAGNITCKSNITG
LLLTRDGGKNNTETFRPGGGDMRDNWRSELYKYKVVEIKPLGIAPTKAKTLTVQARQLLSGIVQQQSNLLRAIEAQQHMLQLTVW
GIKQLQTRVLAIERYLKDQQLLGIWGCSGKLICTTAVPWNSSWSNKSQEDIWDNMTWMQWDREISNYTDTIYRLLEDSQNQQEKN
EKDLLALDSWKNLWNWFDITNWLW*

*Amino acids seen in blue color is for easy identification of the junction of the deleted fusion cleavage site.

Fig. 31C

CODON-OPTIMIZED Con-C-2003 140CF (1,888 nt.)

Nick name:003

TTCAGTCGACAGCCACCATGCGAGTGAGAGGCATTCTGCGGAATTGTCAGCAATGGTGGATCTGGGGCATACTCGGATTCTGGAT
GCTTATGATATGCAATGTTGTGGGGAACCTGTGGGTTACCGTATACTATGGGGTTCCAGTCTGGAAGGAGGCTAAAACAACGCTG
TTCTGTGCAAGTGACGCCAAAGCCTACGAGAAAGAAGTGCACAACGTCTGGGCTACCCACGCTTGTGTTCCAACCGATCCAAACC
CCCAGGAAATCGTCCTCGAGAACGTGACTGAAAACTTTAACATGTGGAAGAATGATATGGTAGATCAGATGCACGAAGATATCAT
TTCATTGTGGGACCAATCATTGAAACCATGCGTAAAACTGACCCCCCTCTGCGTAACACTTAACTGCACCAATGCAACTAATGCC
ACCAATACTATGGGCGAAATAAAAAACTGTAGCTTTAACATTACAACGGAACTCCGGGATAAGAAACAAAAGGTCTACGCGCTCT
TTTACCGACTCGATATCGTCCCACTTAACGAGAATAATAGTTACCGCCTGATTAACTGTAACACATCAGCCATTACGCAAGCTTG
CCCCAAAGTTTCTTTCGACCCCATCCCAATTCACTATTGTGCCCCCGCTGGATACGCTATACTTAAATGCAACAATAAAACATTT
AATGGAACCGGACCATGTAACAACGTCAGTACCGTACAATGTACGCACGGAATTAAACCTGTTGTCTCAACCCAGCTTCTCCTTA
ACGGCTCATTGGCGGAGGAAGAAATTATTATCAGATCAGAAAACTTGACCAACAATGCCAAAACCATCATCGTGCACCTCAATGA
ATCCGTGGAAATCGTGTGCACCAGACCAAATAACAATACCCGGAAATCAATCAGGATTGGGCCTGGCCAGACATTTTACGCTACA
GGTGATATAATTGGCGATATTAGACAAGCCCATTGCAACATATCAGAAGACAAGTGGAATAAGACTCTGCAGAAGGTTTCTAAGA
AGCTGAAGGAACACTTTCCCAATAAAACGATTAAGTTCGAGCCCTCTTCAGGAGGAGACCTTGAGATCACAACACACTCTTTTAA
TTGTAGAGGGGAGTTCTTCTATTGTAATACATCAAAGCTCTTTAACAGTACCTACAACTCCACTAATAGTACCATCACACTCCCC
TGCAGAATAAAGCAAATAATCAACATGTGGCAAGAAGTTGGCCGAGCAATGTACGCCCCTCCCATCGCAGGCAACATTACATGTA
AATCCAATATTACTGGCCTTTTGCTGACACGGGACGGCGGAAAGAATAACACTGAGACCTTCAGACCTGGCGGAGGCGATATGCG
CGATAATTGGCGGAGCGAGCTCTACAAGTATAAAGTCGTTGAAATCAAGCCACTGGGCATAGCTCCTACGAAAGCAAAGACACTC
ACTGTTCAGGCTAGACAGCTGCTCTCCGGCATAGTGCAACAGCAATCCAATCTCCTGCGAGCTATCGAAGCCCAACAACATATGC
TCCAGCTTACCGTCTGGGGAATCAAACAATTGCAAACACGAGTGCTGGCGATAGAGAGATATTTGAAAGATCAGCAACTCCTGGG
GATTTGGGGCTGTTCAGGTAAGCTCATCTGTACAACTGCGGTGCCGTGGAACTCAAGCTGGAGTAACAAAAGCCAAGAGGATATA
TGGGACAACATGACTTGGATGCAGTGGGATCGAGAAATAAGCAACTATACAGATACCATTTATCGGCTCCTGGAGGACTCACAGA
ACCAGCAGGAGAAAAATGAGAAAGATTTGCTCGCGCTTGACAGTTGGAAGAATTTGTGGAATTGGTTCGACATTACAAACTGGCT
CTGGTAAAGATCTTACAA

Fig. 32A

CONSENSUS_G-2003 (842 a.a.)

MRVKGIQRNWQHLWKWGTLILGLVIICSASNNLWVTVYYGVPVWEDADTTLFCASDAKAYSTERHNVWATHACVPTDPNPQEITL
ENVTENFNMWKNNMVEQMHEDIISLWDESLKPCVKLTPLCVTLNCTDVNVTNNNTNNTKKEIKNCSFNITTEIRDKKKKEYALFY
RLDVVPINDNGNSSIYRLINCNVSTIKQACPKVTFDPIPIHYCAPAGFAILKCRDKKFNGTGPCKNVSTVQCTHGIKPVVSTQLL
LNGSLAEEEIIIRSENITDNTKVIIVQLNETIEINCTRPNNNTRKSIRIGPGQAFYATGDIIGDIRQAHCNVSRTKWNEMLQKVK
AQLKKIFNKSITFNSSSGGDLEITTHSFNCRGEFFYCNTSGLFNNSLLNSTNSTITLPCKIKQIVRMWQRVGQAMYAPPIAGNIT
CRSNITGLLLTRDGGNNNTETFRPGGGDMRDNWRSELYKYKIVKIKPLGVAPTRARRVVEREKRAVGLGAVLLGFLGAAGSTMG
AASITLTVQVRQLLSGIVQQQSNLLRAIEAQQHLLQLTVWGIKQLQARVLAVERYLKDQQLLGIWGCSGKLICTTNVPWNTSWSN
KSYNEIWDNMTWIEWEREISNYTQQIYSLIEESQNQQEKNEQDLLALDKWASLWNWFDITKWLWYIKIFIMIVGGLIGLRIVFAV
LSIVNRVRQGYSPLSFQTLTHHQREPDRPERIEEGGGEQDKDRSIRLVSGFLALAWDDLRSLCLFSYHRLRDFILIAARTVELLG
RSSLKGLRLGWEGLKYLWNLLLYWGQELKNSAINLLDTIAIAVANWTDRVIEVAQRACRAILNIPRRIRQGLERALL

*Amino acid sequence underlined is the fusion domain that will be deleted in 140CF design and the "W" underlined with red color is the last amino acid at the C terminus, and all the remaining amino acids after the "W" will be deleted in 140CF design.

Fig. 32B

Con-G-2003 140CF (626 a.a.)

Nick name: 007

MRVKGIQRNWQHLWKWGTLILGLVIICSASNNLWVTVYYGVPVWEDADTTLFCASDAKAYSTERHNVWATHACVPTDPNPQEITL
ENVTENFNMWKNNMVEQMHEDIISLWDESLKPCVKLTPLCVTLNCTDVNVTNNNTNNTKKEIKNCSFNITTEIRDKKKKEYALFY
RLDVVPINDNGNSSIYRLINCNVSTIKQACPKVTFDPIPIHYCAPAGFAILKCRDKKFNGTGPCKNVSTVQCTHGIKPVVSTQLL
LNGSLAEEEIIIRSENITDNTKVIIVQLNETIEINCTRPNNNTRKSIRIGPGQAFYATGDIIGDIRQAHCNVSRTKWNEMLQKVK
AQLKKIFNKSITFNSSSGGDLEITTHSFNCRGEFFYCNTSGLFNNSLLNSTNSTITLPCKIKQIVRMWQRVGQAMYAPPIAGNIT
CRSNITGLLLTRDGGNNNTETFRPGGGDMRDNWRSELYKYKIVKIKPLGVAPTRARTLTVQVRQLLSGIVQQQSNLLRAIEAQQH
LLQLTVWGIKQLQARVLAVERYLKDQQLLGIWGCSGKLICTTNVPWNTSWSNKSYNEIWDNMTWIEWEREISNYTQQIYSLIEES
QNQQEKNEQDLLALDKWASLWNWFDITKWLW*

*Amino acids seen in blue color is for easy identification of the junction of the deleted fusion cleavage site

Fig. 32C

CODON-OPTIMIZED Con-G-2003 140CF.seq

Nick name:007

TTCAGTCGACAGCCACCATGCGAGTGAAGGGAATCCAGAGAAATTGGCAGCACCTTTGGAAGTGGGGCACACTCATCCTCGGCCT
TGTGATCATATGCTCTGCCTCAAATAACCTTTGGGTCACAGTTTATTACGGCGTGCCCGTTTGGGAGGACGCAGACACAACTCTT
TTTTGTGCCAGCGACGCTAAGGCTTATTCAACAGAGAGGCATAACGTTTGGGCTACACATGCATGCGTGCCGACCGATCCTAATC
CCCAGGAAATCACTCTTGAGAATGTTACAGAGAATTTTAATATGTGGAAGAACAACATGGTTGAACAGATGCATGAAGACATAAT
TTCTCTCTGGGATGAATCTCTGAAACCTTGCGTGAAGCTTACACCACTGTGCGTTACCCTGAATTGCACTGACGTCAATGTCACA
AATAATAATACCAACAATACAAAAAAAGAAATCAAAAATTGTTCTTTCAACATAACCACCGAGATACGCGATAAAAAAAAGAAAG
AATACGCCCTGTTCTACAGACTCGATGTGGTCCCAATTAATGACAACGGAAATTCTTCCATCTACCGACTTATCAATTGTAACGT
GTCTACAATCAAACAGGCCTGTCCTAAAGTCACATTTGACCCTATTCCCATTCATTACTGTGCCCCCGCTGGCTTCGCTATTCTT
AAATGCCGAGACAAAAAATTTAACGGAACAGGACCATGCAAGAATGTCTCAACAGTTCAATGCACTCATGGAATTAAACCAGTCG
TTTCTACTCAACTCCTTCTCAATGGAAGCCTGGCAGAAGAGGAAATCATAATCCGCAGCGAAAACATAACCGACAACACAAAAGT
AATCATCGTACAGCTGAACGAGACCATTGAAATAAATTGTACGAGACCTAATAATAACACAAGAAAAAGCATACGCATCGGCCCC
GGACAGGCTTTCTACGCCACAGGAGACATTATCGGAGATATCCGCCAGGCTCACTGTAATGTGTCTAGAACAAAATGGAACGAAA
TGCTTCAGAAGGTCAAAGCTCAGCTCAAGAAAATATTCAACAAATCTATTACATTCAACTCATCATCAGGCGGCGATCTGGAGAT
AACAACTCATTCCTTCAACTGTCGGGGAGAATTTTTTTACTGTAACACGTCCGGCCTGTTCAACAATTCACTCCTGAATAGCACT
AACTCCACCATCACTCTCCCATGTAAGATCAAACAAATCGTCAGAATGTGGCAGCGAGTCGGTCAAGCTATGTACGCCCCTCCAA
TCGCCGGTAATATCACATGTAGAAGCAATATCACAGGGCTCTTGCTTACAAGGGACGGCGGGAACAACAACACCGAAACCTTCAG
ACCAGGAGGAGGAGACATGCGAGACAATTGGCGGAGCGAGCTGTATAAATATAAGATCGTAAAAATCAAACCATTGGGTGTAGCG
CCAACTAGAGCCCGAACACTGACCGTGCAGGTGAGGCAACTGCTGAGCGGCATTGTCCAACAACAATCCAATCTTCTTAGAGCAA
TCGAGGCCCAGCAGCATCTGCTCCAGCTTACTGTATGGGGAATCAAACAACTGCAAGCAAGAGTATTGGCAGTGGAGAGGTATCT
CAAGGACCAGCAGCTTCTGGGAATTTGGGGTTGCAGCGGAAAGCTCATATGTACAACCAATGTGCCCTGGAACACTAGTTGGAGT
AATAAGAGTTACAATGAAATCTGGGACAATATGACATGGATCGAATGGGAGCGCGAAATATCCAACTATACTCAGCAAATCTATT
CCCTCATTGAAGAGAGTCAGAACCAGCAGGAAAAGAATGAGCAAGACCTCCTCGCCCTGGATAAATGGGCATCTCTGTGGAACTG
GTTTGACATAACTAAATGGTTGTGGTAAAGATCTTACAA

Fig. 33A

CONSENSUS_01_AE-2003 (854 a.a.)

MRVKETQMNWPNLWKWGTLILGLVIICSASDNLWVTVYYGVPVWRDADTTLFCASDAKAHETEVHNVWATHACVPTDPNPQEIHL
ENVTENFNMWKNNMVEQMQEDVISLWDQSLKPCVKLTPLCVTLNCTNANLTNVNNITNVSNIIGNITNEVRNCSFNMTTELRDKK
QKVHALFYKLDIVQIEDNNSYRLINCNTSVIKQACPKISFDPIPIHYCTPAGYAILKCNDKNFNGTGPCKNVSSVQCTHGIKPVV
STQLLLNGSLAEEEIIIRSENLTNNAKTIIVHLNKSVEINCTRPSNNTRTSITIGPGQVFYRTGDIIGDIRKAYCEINGTKWNEV
LKQVTEKLKEHFNNKTIIFQPPSGGDLEITMHHFNCRGEFFYCNTTKLFNNTCIGNETMEGCNGTIILPCKIKQIINMWQGAGQA
MYAPPISGRINCVSNITGILLTRDGGANNTNETFRPGGGNIKDNWRSELYKYKVVQIEPLGIAPTRAKRRVVEREKRAVGIGAMI
FGFLGAAGSTMGAASITLTVQARQLLSGIVQQQSNLLRAIEAQQHLLQLTVWGIKQLQARVLAVERYLKDQKFLGLWGCSGKIIC
TTAVPWNSTWSNRSFEEIWNNMTWIEWEREISNYTNQIYEILTESQNQQDRNEKDLLELDKWASLWNWFDITNWLWYIKIFIMIV
GGLIGLRIIFAVLSIVNRVRQGYSPLSFQTPTHHQREPDRPERIEEGGGEQGRDRSVRLVSGFLALAWDDLRSLCLFSYHRLRDF
ILIAARTVELLGHSSLKGLRRGWEGLKYLGNLLLYWGQELKISAISLLDATAIAVAGWTDRVIEVAQGAWRAILHIPRRIRQGLE
RALL

*Amino acid sequence underlined is the fusion domain that will be deleted in 140CF design and the "W" underlined with red color is the last amino acid at the C terminus, and all the remaining amino acids after the "W" will be deleted as 140CF

Fig. 33B

Con-AE01-2003 140CF.pep (638 a.a.)

Nick name: 008

MRVKETQMNWPNLWKWGTLILGLVIICSASDNLWVTVYYGVPVWRDADTTLFCASDAKAHETEVHNVWATHACVPTDPNPQEIHL
ENVTENFNMWKNNMVEQMQEDVISLWDQSLKPCVKLTPLCVTLNCTNANLTNVNNITNVSNIIGNITNEVRNCSFNMTTELRDKK
QKVHALFYKLDIVQIEDNNSYRLINCNTSVIKQACPKISFDPIPIHYCTPAGYAILKCNDKNFNGTGPCKNVSSVQCTHGIKPVV
STQLLLNGSLAEEEIIIRSENLTNNAKTIIVHLNKSVEINCTRPSNNTRTSITIGPGQVFYRTGDIIGDIRKAYCEINGTKWNEV
LKQVTEKLKEHFNNKTIIFQPPSGGDLEITMHHFNCRGEFFYCNTTKLFNNTCIGNETMEGCNGTIILPCKIKQIINMWQGAGQA
MYAPPISGRINCVSNITGILLTRDGGANNTNETFRPGGGNIKDNWRSELYKYKVVQIEPLGIAPTRAKTLTVQARQLLSGIVQQQ
SNLLRAIEAQQHLLQLTVWGIKQLQARVLAVERYLKDQKFLGLWGCSGKIICTTAVPWNSTWSNRSFEEIWNNMTWIEWEREISN
YTNQIYEILTESQNQQDRNEKDLLELDKWASLWNWFDITNWLW*

*Amino acids seen in blue color is for easy identification of the junction of the deleted fusion cleavage site.

Fig. 33C

CODON-OPTIMIZED Con-AE01-2003 140CF.seq (1945 nt.)

Nick name: 008 ttcagtcgacagccaccATGCGAGTCAAGGAAACACAAATGAACTGGCCTAATCTGTGGAAGTGGGGCACCCTGATCCTGGGTTT
GGTCATTATTTGCTCTGCGAGCGACAATCTCTGGGTTACTGTCTATTACGGAGTCCCCGTTTGGAGAGATGCCGACACTACACTG
TTCTGCGCCTCAGATGCCAAAGCTCATGAAACTGAAGTGCATAATGTTTGGGCAACCCACGCCTGTGTTCCTACCGACCCAAACC
CCCAAGAAATACACCTGGAAAACGTGACCGAGAACTTTAATATGTGGAAGAATAACATGGTTGAACAGATGCAAGAAGACGTAAT
CAGCCTGTGGGATCAAAGTCTGAAACCTTGCGTAAAACTGACTCCACTTTGCGTAACACTTAATTGCACCAACGCGAACCTGACA
AACGTTAACAACATCACTAACGTCTCCAACATCATCGGCAACATAACGAACGAAGTGAGAAATTGCAGTTTCAATATGACTACAG
AGCTCCGGGACAAGAAACAGAAGGTCCATGCTCTCTTTTACAAACTCGACATCGTCCAGATCGAAGACAATAACAGCTACAGACT
TATAAATTGTAATACATCCGTGATTAAACAAGCATGCCCCAAAATAAGCTTCGATCCTATTCCTATCCACTACTGTACTCCTGCC
GGCTATGCTATCTTGAAATGCAATGATAAGAACTTCAATGGGACCGGACCTTGTAAGAACGTGTCTAGTGTGCAATGCACTCACG
GCATTAAACCAGTGGTAAGCACCCAGCTGCTCCTGAACGGCTCTCTGGCAGAGGAAGAGATTATTATTCGAAGTGAGAACCTCAC
CAACAACGCTAAGACTATCATCGTACATCTCAATAAATCAGTCGAAATTAATTGCACCAGACCCTCCAATAATACTAGAACTTCA
ATCACTATCGGCCCAGGACAAGTCTTTTATAGAACAGGAGATATCATAGGAGATATCAGAAAGGCATATTGCGAGATAAACGGGA
CAAAATGGAACGAAGTACTCAAACAAGTCACAGAGAAGCTTAAGGAACATTTCAACAATAAAACCATTATTTTTCAACCCCCAAG
TGGCGGAGACCTCGAAATCACTATGCACCACTTCAACTGCCGCGGCGAATTTTTTTATTGCAATACCACTAAACTTTTCAACAAT
ACGTGCATCGGAAATGAGACCATGGAGGGCTGCAATGGAACAATCATACTCCCATGCAAGATAAAACAAATCATTAACATGTGGC
AAGGTGCTGGACAAGCTATGTATGCACCCCCAATATCCGGTAGAATTAATTGCGTCAGCAACATCACTGGCATACTGCTCACTAG
AGACGGAGGAGCAAATAATACAAATGAAACATTCCGACCAGGCGGCGGCAACATTAAGGACAACTGGCGGTCCGAACTCTATAAG
TACAAAGTCGTACAGATCGAACCTCTTGGAATAGCACCGACTCGCGCTAAGACACTCACAGTACAGGCCCGACAACTTCTTTCTG
GAATCGTACAGCAGCAATCCAACCTCCTCCGCGCAATCGAGGCCCAACAACATCTGCTTCAGCTCACAGTTTGGGGAATCAAGCA
GCTCCAGGCACGCGTGCTCGCAGTGGAAAGATACCTGAAGGATCAGAAATTCCTTGGTCTCTGGGGATGTTCTGGCAAAATAATC
TGCACTACCGCGGTTCCCTGGAATTCAACATGGAGCAACCGGAGTTTTGAAGAGATATGGAACAATATGACATGGATAGAGTGGG
AAAGGGAAATTAGTAACTATACGAACCAGATATACGAAATCCTCACCGAAAGCCAAAATCAGCAGGATCGCAACGAAAAAGACCT
CCTCGAGCTTGATAAGTGGGCATCCCTTTGGAACTGGTTCGACATCACAAATTGGCTCTGGtaaagatcttacaa

Fig. 34A

Wild-type subtype A Env

00KE_MSA4076-A (Subtype A, 891 a.a)

MGAMGIQMNWQNLWRWGTMILGMLIICSVAEKSWVTVYYGVPVWRDAETTLFCASDAKAHDKEVHNVWATHACVPTDPNPQEMIL
ENVTEDFNMWKNSMVEQMHTDIISLWDQSLKPCVKLTPLCVTLNCSDSNITSNSTSNSTKDSATLDMKSEIQNCSFNMTTELRDK
KQKVYSLFYRLDVVQINENSSDYRLINCNTSAITQACPKVTFEPIPIHYCAPAGFAILKCNDKKFNGTGPCTNVSTVQCTHGIKP
VVTTQLLLNGSLAEEEVMIRSENITENAKNIIVQFKEPVQIICIRPGNNTRKSVHIGPGQAFYATGDIIGDIRQAHCNVSRELWN
KTLQEVATQLRKHFRNNTKIIFTNSSGGDVEITTHSFNCGGEFFYCDTSGLFNSSWTASNDSMQEAHSTESNITLQCRIKQIINM
WQRAGQAMYAPPIPGIIRCESNITGLILTRDGGEGNNSTNETFRPVGGNMRDNWRSELYKYKVVKVEPLGVAPTKSRRRVVEREK
RAVGLGAVFIGFLGAAGSTMGAASMTLTVQARQLLSGIVQQQSNLLRAIEAQQHLLKLTVWGIKQLQARVLAVERYLRDQQLLGI
WGCSGKLICTTNVPWNSSWSNKSLDEIWENMTWMQWDKEVSNYTQMIYNLLEESQNQQEKNEQELLALDKWANLWNWFNISNWLW
YIKIFIMIVGGLIGLRIVFAVLSVINRVRQGYSPLSFQTHTPNPRGLDRPGRIEEEGGEQDRDRSIRLVSGFLALAWDDLRSLCL
FSYHRLRDFILIAARTLELLGHNSLKGLRLGWEGLKYLWNLLAYWGRELKISAISLVDSIAIAVAGWTDRIIEIVQAIGRAILHI
PRRIRQGLERALI

*Amino acid sequence underlined is the fusion domain that will be deleted in 140CF design and the "W" underlined with red color is the last amino acid at the C terminus, and all the remaining amino acids after the "W" will be deleted in 140CF design.

Fig. 34B

00KE_MSA4076-A 140CF.pep (647 a.a)

Nick name: 011

MGAMGIQMNWQNLWRWGTMILGMLIICSVAEKSWVTVYYGVPVWRDAETTLFCASDAKAHDKEVHNVWATHACVPTDPNPQEMIL
ENVTEDFNMWKNSMVEQMHTDIISLWDQSLKPCVKLTPLCVTLNCSDSNITSNSTSNSTKDSATLDMKSEIQNCSFNMTTELRDK
KQKVYSLFYRLDVVQINENSSDYRLINCNTSAITQACPKVTFEPIPIHYCAPAGFAILKCNDKKFNGTGPCTNVSTVQCTHGIKP
VVTTQLLLNGSLAEEEVMIRSENITENAKNIIVQFKEPVQIICIRPGNNTRKSVHIGPGQAFYATGDIIGDIRQAHCNVSRELWN
KTLQEVATQLRKHFRNNTKIIFTNSSGGDVEITTHSFNCGGEFFYCDTSGLFNSSWTASNDSMQEAHSTESNITLQCRIKQIINM
WQRAGQAMYAPPIPGIIRCESNITGLILTRDGGEGNNSTNETFRPVGGNMRDNWRSELYKYKVVKVEPLGVAPTKSRTLTVQARQ
LLSGIVQQQSNLLRAIEAQQHLLKLTVWGIKQLQARVLAVERYLRDQQLLGIWGCSGKLICTTNVPWNSSWSNKSLDEIWENMTW
MQWDKEVSNYTQMIYNLLEESQNQQEKNEQELLALDKWANLWNWFNISNWLW*

*Amino acids seen in blue color is for easy identification of the junction of the deleted fusion cleavage site.

Fig. 34C

CODON-OPTIMIZED 00KE_MSA4076-A 140CF.seq (1972 nt.)

Nick name: 011 ttcagtcgacagccaccATGGGGGCAATGGGAATCCAGATGAACTGGCAGAACCTCTGGCGATGGGGCACAATGATCCTGGGTAT
GCTCATCATCTGCTCTGTTGCAGAAAAGTCATGGGTAACAGTCTACTACGGCGTACCAGTGTGGCGGGACGCCGAAACCACTCTC
TTCTGCGCCTCCGATGCCAAAGCACACGATAAAGAAGTCCACAATGTTTGGGCTACCCATGCGTGCGTGCCAACCGATCCTAACC
CACAAGAAATGATACTCGAAAACGTTACTGAAGACTTCAACATGTGGAAAAATTCTATGGTTGAACAGATGCACACCGACATAAT
ATCACTGTGGGATCAGTCTCTCAAACCCTGTGTCAAATTGACCCCCCTCTGCGTTACACTGAACTGTTCCGACTCAAATATCACT
TCTAATTCAACGAGCAATAGTACGAAAGACTCCGCAACCCTTGATATGAAAAGCGAAATACAGAACTGTTCATTTAATATGACCA
CCGAACTGAGAGATAAAAAGCAGAAGGTTTATTCTCTGTTCTATCGATTGGACGTGGTTCAGATTAACGAAAATAGCAGCGATTA
CCGACTCATTAACTGCAATACATCAGCAATCACACAGGCTTGCCCAAAGGTAACATTTGAGCCAATCCCTATTCACTACTGCGCC
CCTGCAGGATTTGCCATCCTGAAATGCAACGATAAGAAGTTTAATGGACAGGACCCTGCACCAACGTCTCCACCGTGCAATGCA
CCCACGGCATAAAACCTGTTGTTACCACACAATTGCTGCTCAATGGATCACTTGCTGAAGAGGAAGTCATGATTCGGTCTGAAAA
CATCACTGAAAATGCCAAAAATATTATAGTTCAGTTCAAAGAACCCGTCCAGATCATTTGCATTCGCCCTGGTAACAACACTCGC
AAGTCAGTGCACATTGGGCCCGGCCAGGCTTTCTATGCAACCGGAGATATTATAGGCGACATCAGACAGGCACATTGCAACGTCA
GCCGGGAATTGTGGAACAAAACTTTGCAGGAAGTTGCTACTCAGCTGCGAAAACATTTCAGAAACAATACAAAGATTATTTTCAC
TAATTCATCAGGCGGTGACGTGGAGATCACTACCCATTCATTTAACTGTGGCGGAGAATTCTTCTATTGCGATACCTCTGGGCTC
TTTAATTCCTCATGGACTGCTAGCAACGATTCAATGCAAGAAGCACATTCCACAGAAAGTAATATCACACTGCAGTGCCGAATTA
AACAAATCATCAATATGTGGCAGCGGGCCGGTCAAGCAATGTACGCACCTCCCATCCCCGGAATTATTCGATGTGAGTCTAATAT
CACTGGCCTCATTCTGACCCGAGACGGTGGCGAAGGTAATAATTCTACAAACGAGACTTTCAGACCCGTAGGAGGCAATATGCGA
GACAATTGGCGATCCGAACTGTATAAATATAAAGTGGTGAAGGTAGAACCTCTTGGAGTGGCACCCACCAAATCACGAACCCTGA
CTGTGCAGGCACGCCAACTTCTGAGCGGAATAGTCCAACAGCAATCCAATCTTCTGAGAGCTATAGAAGCCCAGCAACACCTGCT
TAAACTTACGGTGTGGGGAATCAAACAATTGCAGGCAAGAGTGCTGGCAGTGGAACGATACTTGAGAGACCAACAACTCCTGGGA
ATCTGGGGATGTTCCGGTAAGTTGATTTGCACGACAAACGTTCCCTGGAACTCTTCCTGGTCAAACAAGAGTCTGGACGAAATAT
GGGAAAATATGACATGGATGCAGTGGGACAAGGAAGTTAGCAACTATACACAGATGATCTACAACCTCCTCGAAGAATCTCAGAA
TCAACAGGAAAAAAACGAACAAGAACTGCTCGCCCTCGATAAGTGGGCTAACCTCTGGAACTGGTTTAATATTTCAAACTGGTTG
TGGtaaagatcttacaa

Fig. 35A

Wild-type subtype B

QH0515.1g gp160 (861a.a)

MRVKEIRRNCQRLRRWGTMLLGMLMICSATEQLWVTVYYGVPVWKEATTTLFCASDAKAYVTEKHNVWATHACVPTDPNPQEVVL
ENVTENFNMWKNNMVEQMHEDIISLWEQSLKPCVKLTPLCVTLNCTDKLRNDTSGTNSSSWEKVQKGEIKNCSFNITTGIRGRVQ
EYSLFYKLDVIPIDSRNNSNNSTEFSSYRLISCNTSVITQACPKISFEPIPIHYCAPAGFAILKCNDKKFNGTGPCKNVSTVQCT
HGIKPVVSTQLLLNGSLAEEEVVIRSENFTNNVKSIIVQLNKSVVINCTRPNNNTRKSIHIGAGKALYTGEIIGDIRQAHCNLSR
AQWNNTLKQIVIKLREQFGNKTIVFNQSSGGDVEIVMHSFNCGGEFFYCNSTQLFNSTWNGNDTWNDTWKDTTNDNITLPCRIKQ
IVNMWQKVGKAMYAPPIRGQIRCSSKITGLILTRDGGTNGTNETETFRPGGGNMKDNWRSELYKYKVVKIEPLGIAPTKAKRRVV
QREKRAVGTIGAMFLGFLGAAGSTMGAASLTLTVQARLLLSGIVQQQNNLLRAIEAQQHLLQLTVWGIKQLQARVLAVERYLRDQ
QLLGIWGCSGRLICTTNVPWNTSWSNRSLNYIWDNMTWMQWDREINNYTDYIYTLLEDAQNQQEKNEQELLELDKWASLWNWFDI
TNWLWYIKIFIMIVGGLIGLRIVFAVLSIVNRVRQGYSPLSLQTHLPARRGPDRPEGIGEEGGERDRDRSVRLVHGFLALVWEDL
RSLCLFSYHRLRDLLLIVARTVEILGQRGWEALKYWWNLLLYWSLELKNSAVSLVDTIAIAVAEGTDRIIEIARRIFRAFLHIPT
RIRQGLERALL

*Amino acid sequence underlined is the fusion domain that will be deleted in 140CF design and the "W" underlined with red color is the last amino acid at the C terminus, and all the remaining amino acids after the "W" will be deleted in 140CF design

Nick name: 012

MRVKEIRRNCQRLRRWGTMLLGMLMICSATEQLWVTVYYGVPVWKEATTTLFCASDAKAYVTEKHNVWATHACVPTDPNPQEVVL
ENVTENFNMWKNNMVEQMHEDIISLWEQSLKPCVKLTPLCVTLNCTDKLRNDTSGTNSSSWEKVQKGEIKNCSFNITTGIRGRVQ
EYSLFYKLDVIPIDSRNNSNNSTEFSSYRLISCNTSVITQACPKISFEPIPIHYCAPAGFAILKCNDKKFNGTGPCKNVSTVQCT
HGIKPVVSTQLLLNGSLAEEEVVIRSENFTNNVKSIIVQLNKSVVINCTRPNNNTRKSIHIGAGKALYTGEIIGDIRQAHCNLSR
AQWNNTLKQIVIKLREQFGNKTIVFNQSSGGDVEIVMHSFNCGGEFFYCNSTQLFNSTWNGNDTWNDTWKDTTNDNITLPCRIKQ
IVNMWQKVGKAMYAPPIRGQIRCSSKITGLILTRDGGTNGTNETETFRPGGGNMKDNWRSELYKYKVVKIEPLGIAPTKAKTLTV
QARLLLSGIVQQQNNLLRAIEAQQHLLQLTVWGIKQLQARVLAVERYLRDQQLLGIWGCSGRLICTTNVPWNTSWSNRSLNYIWD
NMTWMQWDREINNYTDYIYTLLEDAQNQQEKNEQELLELDKWASLWNWFDITNWLW*

*Amino acids seen in blue color is for easy identification of the junction of the deleted fusion cleavage site.

Fig. 35C

CODON-OPTIMIZED QH0515.1g 140CF.seq (1984 nt.)

Nick name:012 ttcagtcgacagccaccATGAGAGTAAAAGAAATCAGACGCAACTGTCAGAGGTTGAGGAGATGGGGAACGATGCTCCTGGGCAT
GCTGATGATTTGCAGTGCCACCGAACAGCTTTGGGTAACCGTGTACTATGGTGTACCTGTATGGAAAGAAGCCACTACAACCCTG
TTTTGCGCGTCCGACGCAAAAGCCTACGTAACAGAAAAGCACAACGTGTGGGCCACACATGCATGCGTGCCAACAGATCCAAATC
CTCAGGAAGTCGTTCTGGAAAATGTAACAGAAAATTTTAATATGTGGAAAAACAATATGGTAGAGCAGATGCATGAAGATATCAT
CTCACTGTGGGAACAATCCTTGAAACCTTGTGTCAAACTGACCCCACTTTGCGTAACACTTAACTGTACTGATAAGCTTCGCAAT
GATACGTCCGGAACAAATTCAAGCAGCTGGGAAAAAGTGCAAAAGGGCGAAATCAAAAATTGTTCATTTAACATCACTACCGGTA
TCAGAGGGCGGGTACAGGAATATTCTCTTTTCTACAAACTCGACGTCATCCCAATCGACTCCAGAAATAACTCAAATAATAGCAC
AGAATTTAGTAGTTATCGCCTTATAAGCTGCAACACCAGCGTGATTACACAAGCGTGCCCTAAAATCTCTTTTGAGCCCATTCCT
ATTCACTACTGCGCACCAGCCGGCTTCGCCATCCTCAAATGTAACGACAAGAAATTTAACGGAACCGGACCCTGTAAGAATGTGT
CCACCGTTCAATGCACTCATGGAATCAAGCCCGTCGTTTCTACCCAACTTCTTCTCAATGGTAGCCTTGCGGAGGAGGAAGTTGT
GATTCGCTCCGAAAATTTTACAAACAACGTCAAGTCAATCATCGTCCAGCTTAATAAATCCGTCGTTATTAATTGTACAAGACCC
AACAATAACACCAGAAAATCCATTCACATAGGGGCCGGGAAAGCTCTGTATACCGGGGAAATTATTGGAGACATCAGACAAGCAC
ACTGTAACTTGAGTCGCGCCCAGTGGAACAACACATTGAAACAGATCGTGATCAAGCTCAGAGAGCAGTTCGGGAATAAGACTAT
CGTGTTTAATCAGAGCTCCGGCGGTGATGTCGAAATCGTAATGCACTCTTTTAATTGTGGGGGTGAATTTTTTTACTGCAATTCT
ACACAATTGTTTAACAGCACCTGGAACGGCAATGACACATGGAATGACACCTGGAAAGATACGACAAATGATAATATTACTCTTC
CGTGCAGAATAAAGCAAATCGTAAATATGTGGCAAAAAGTGGGCAAGGCCATGTACGCACCACCTATAAGAGGACAAATTCGCTG
TTCTTCCAAGATCACAGGTCTGATACTCACACGGGACGGAGGCACGAACGGGACAAACGAGACCGAGACCTTCCGACCAGGAGGC
GGCAACATGAAGGATAACTGGAGAAGTGAACTTTACAAGTATAAAGTGGTCAAGATTGAGCCTCTGGGTATCGCCCCTACTAAGG
CTAAAACACTCACCGTGCAGGCTAGATTGCTGCTTTCAGGGATAGTCCAACAACAGAACAACCTTCTTAGAGCCATTGAAGCACA
ACAACACTTGCTGCAGTTGACAGTGTGGGGAATTAAACAGTTGCAGGCCCGGGTTCTCGCTGTCGAACGGTATCTTAGAGATCAG
CAGCTTTTGGGTATCTGGGGGTGTTCAGGCCGCCTCATATGCACCACAAATGTCCCTTGGAATACCTCATGGAGTAACAGGTCTC
TTAATTATATTTGGGACAATATGACATGGATGCAATGGGATAGAGAAATTAATAACTACACCGACTACATCTACACACTTCTGGA
GGACGCCCAGAATCAGCAGGAGAAGAACGAGCAGGAACTCCTCGAATTGGATAAGTGGGCATCACTGTGGAATTGGTTCGATATA
ACTAATTGGCTTTGGtaaagatcttacaa

Fig. 36A

Wild-type subtype C
DU123.6 gp160(854 a.a)

MRVKGIQRNWPQWWIWGILGFWMIIICRVVGNLWVTVYYGVPVWTEAKTTLFCASDAKAYEREVHNVWATHACVPTDPNPQEIVL
GNVTENFNMWKNDMVDQMHEDIISIWDQSLKPCVKLTPLCVTLNCTDVKVNATSNGTTTYNNSIDSMNGEIKNCSFNITTEIRDK
KQKVYALFYRPDVVPLNENSSSYILINCNTSTTTQACPKVSFDPIPIHYCAPAGYAILKCNNKTFNGTGPCHNVSTVQCTHGIKP
VVSTQLLLNGSLAEEEIIIRSENLTNNAKTIIVHLNESIEIVCTRPNNNTRKSIRIGPGQTVYATNDIIGDIRQAHCNISKTKWN
TTLEKVKEKLKEHFPSKAITFQPHSGGDLEVTTHSFNCRGEFFYCDTTKLFNESNLNTTNTTTLTLPCRIKQIVNMWQGVGRAMY
APPVEGNITCNSSITGLLLVRDGGNTSNSTPEIFRPGGGNMKDNWRSELYKYKVVEIKPLGVAPTKAKRRVVEREKRAVGIGAVL
FGFLGAAGSTMGAASITLTVQARQLLSGIVQQQSNLLRAIEAQQHMLQLTVWGIKQLQARVLAIERYLKDQQLLGLWGCSGKLIC
PTTVPWNSSWSNKSQTDIWDNMTWMQWDREISNYTGTIYKLLEESQNQQEKNEKDLLALDSWKNLWSWFDITNWLWYIKIFIMIV
GGLIGLRIIFGVLSIVKRVRQGYSPLSFQTLTPNPRGLDRLGRIEEEGGEQDKDRSIRLVNGFLALAWDDLRSLCLFSYHRLRDF
ILVAARAVELLGRSSLRGLQRGWEALKYLGNLVQYGGLELKRRAISLFDTIAIAVAEGTDRILEVILRIIRAIRNIPTRIRQGFE
AALL

Fig. 36B

DU123.6 140CF (638 a.a)
Nick name: 013

MRVKGIQRNWPQWWIWGILGFWMIIICRVVGNLWVTVYYGVPVWTEAKTTLFCASDAKAYEREVHNVWATHACVPTDPNPQEIVL
GNVTENFNMWKNDMVDQMHEDIISIWDQSLKPCVKLTPLCVTLNCTDVKVNATSNGTTTYNNSIDSMNGEIKNCSFNITTEIRDK
KQKVYALFYRPDVVPLNENSSSYILINCNTSTTTQACPKVSFDPIPIHYCAPAGYAILKCNNKTFNGTGPCHNVSTVQCTHGIKP
VVSTQLLLNGSLAEEEIIIRSENLTNNAKTIIVHLNESIEIVCTRPNNNTRKSIRIGPGQTVYATNDIIGDIRQAHCNISKTKWN
TTLEKVKEKLKEHFPSKAITFQPHSGGDLEVTTHSFNCRGEFFYCDTTKLFNESNLNTTNTTTLTLPCRIKQIVNMWQGVGRAMY
APPVEGNITCNSSITGLLLVRDGGNTSNSTPEIFRPGGGNMKDNWRSELYKYKVVEIKPLGVAPTKAKTLTVQARQLLSGIVQQQ
SNLLRAIEAQQHMLQLTVWGIKQLQARVLAIERYLKDQQLLGLWGCSGKLICPTTVPWNSSWSNKSQTDIWDNMTWMQWDREISN
YTGTIYKLLEESQNQQEKNEKDLLALDSWKNLWSWFDITNWLW*

*Amino acids seen in blue color is for easy identification of the junction of the deleted fusion cleavage site.

Fig. 36C

CODON-OPTIMIZED DU123.6 140CF.seq (1945 nt.)

Nick name: 013 ttcagtcgacagccaccATGCGCGTAAAGGGGATTCAAAGAAATTGGCCGCAATGGTGGATTTGGGGAATTCTGGGCTTTTGGAT
GATAATTATATGCCGCGTTGTCGGAAATTTGTGGGTGACTGTGTACTACGGGGTGCCCGTGTGGACTGAGGCAAAGACCACCCTG
TTCTGTGCTAGCGATGCCAAAGCCTATGAACGCGAAGTGCACAATGTTTGGGCTACTCATGCCTGTGTCCCTACCGACCCAAACC
CTCAGGAAATAGTGCTCGGCAATGTAACGGAAAACTTCAACATGTGGAAAAATGATATGGTGGATCAGATGCACGAAGACATTAT
CTCAATCTGGGACCAAAGCCTGAAACCCTGCGTTAAACTGACTCCTCTCTGCGTCACTCTCAATTGCACAGATGTCAAAGTGAAT
GCCACCTCAAACGGTACGACAACTTACAACAATTCTATTGACTCTATGAACGGCGAAATCAAAAATTGTTCCTTTAACATCACCA
CCGAGATACGCGACAAAAAGCAGAAGGTCTATGCCCTTTTTTACCGCCCCGACGTAGTCCCACTCAACGAGAATTCCAGCTCATA
CATCCTCATCAACTGCAATACATCAACTACCACACAAGCATGCCCGAAAGTTAGCTTTGATCCAATTCCTATACATTACTGCGCC
CCCGCCGGCTACGCTATACTGAAATGCAATAATAAGACTTTTAACGGGACCGGCCCATGTCACAACGTGTCAACCGTGCAATGCA
CTCATGGCATCAAGCCCGTGGTGTCAACCCAGCTGCTGCTCAATGGCTCACTTGCAGAAGAAGAAATTATTATCCGCTCTGAGAA
TCTTACTAACAATGCAAAAACGATTATCGTGCACCTTAATGAATCAATAGAAATCGTGTGTACTCGGCCCAACAATAATACTAGA
AAAAGCATTCGCATCGGACCTGGCCAGACAGTTTACGCAACTAATGACATCATCGGGGACATCCGACAGGCCCATTGCAACATTT
CTAAAACCAAGTGGAATACAACCCTGGAAAAAGTAAAGGAAAAACTTAAAGAACATTTTCCCTCTAAGGCGATCACGTTTCAACC
TCACAGTGGCGGAGACTTGGAAGTCACAACACATTCTTTTAACTGCCGCGGAGAATTTTTTTATTGTGATACAACAAAACTTTTT
AATGAATCAAATCTCAACACCACAAATACAACCACACTGACCCTCCCCTGTAGAATCAAACAAATCGTAAACATGTGGCAAGGGG
TTGGAAGGGCTATGTACGCTCCCCCCGTCGAAGGAAATATAACGTGTAACAGCAGCATCACTGGGCTGCTTCTTGTTCGAGACGG
AGGCAATACTTCTAATTCAACTCCTGAAATTTTTAGGCCTGGCGGTGGCAATATGAAAGATAACTGGCGCTCAGAACTGTACAAA
TACAAAGTTGTTGAAATTAAGCCCCTGGGAGTCGCTCCAACCAAAGCTAAAACACTCACAGTGCAAGCAAGACAGCTCCTTTCAG
GCATCGTCCAGCAACAGTCAAATCTCCTTAGAGCAATCGAAGCCCAACAGCATATGCTCCAACTCACAGTCTGGGGGATTAAACA
GCTTCAAGCCCGCGTGCTTGCTATCGAACGCTATCTTAAAGACCAACAGCTTCTTGGCCTCTGGGGTTGTAGTGGAAAACTCATC
TGCCCCACCACCGTGCCTTGGAATAGTTCTTGGAGTAATAAATCACAGACCGATATTTGGGACAACATGACCTGGATGCAATGGG
ATAGGGAAATTTCTAATTATACTGGCACAATCTACAAACTCTTGGAAGAAAGTCAAAATCAGCAAGAAAAAAACGAAAAGGACCT
CCTCGCCCTGGACTCCTGGAAGAATCTTTGGAGCTGGTTCGACATAACTAATTGGCTGTGGtaaagatcttacaa

Fig. 37A

Wild-type subtype CRF01_AE

97CNGX2F-AE (854 a.a.)

MRVKETQMNWPNLWKWGTLILGLVIICSASDNLWVTVYYGVPVWRDADTTLFCASDAKAHETEVHNVWATHACVPTDPNPQEIHL
ENVTENFNMWRNNMVEQMQEDVISLWDQSLKPCVKLTPLCVTLNCTNANWTNSNNTTNGPNKIGNITDEVKNCTFNMTTELKDKK
QKVHALFYKLDIVQINSSEYRLINCNTSVIKQACPKISFDPIPIHYCTPAGYAILKCNDKNFNGTGPCKNVSSVQCTHGIKPVVS
TQLLLNGSLAEEEIIIRSENLTNNAKTIIVHLNKSVEINCTRPSNNTRTSITMGPGQVFYRTGDIIGDIRKAYCEINGIKWNEVL
VQVTGKLKEHFNKTIIFQPPSGGDLEIITHHFSCRGEFFYCNTTKLFNNTCIGNTSMEGCNNTIILPCKIKQIINMWQGVGQAMY
APPISGRINCVSNITGILLTRDGGADNNTTNETFRPGGGNIKDNWRSELYKYKVVEIEPLGIAPTRAKRRVVEREKRAVGIGAMI
FGFLGAAGSTMGAASITLTVQARQLLSGIVQQQSNLLRAIEAQQHLLQLTVWGIKQLQARVLAVERYLKDQKFLGLWGCSGKIIC
TTAVPWNSSWSNKSFEEIWDNMTWIEWEREISNYTSQIYEILTESQNQQDRNEKDLLELDKWASLWNWFDITNWLWYIKIFIIIV
GSLIGLRIIFAVLSIVNRVRQGYSPLSFQTPTHHQREPDRPEEIGEGGGEQSKDRSVRLVSGFLALAWDDLRSLCLFSYHLLRDF
ILIAARTVELLGHSSLKGLRRGWEGLKYLGNLLLYWGQEIKISAISLLNATAIAVAGWTDRVIEVAQRAWRALLHIPRRIRQGLE
RALL

*Amino acid sequence underlined is the fusion domain that will be deleted in 140CF design and the "W" underlined with red color is the last amino acid at the C terminus, and all the remaining amino acids after the "W" will be deleted in 140CF design.

Fig. 37B

97CNGX2F-AE 140CF.pep (629 a.a.)

Nick name: 018

MRVKETQMNWPNLWKWGTLILGLVIICSASDNLWVTVYYGVPVWRDADTTLFCASDAKAHETEVHNVWATHACVPTDPNPQEIHL
ENVTENFNMWRNNMVEQMQEDVISLWDQSLKPCVKLTPLCVTLNCTNANWTNSNNTTNGPNKIGNITDEVKNCTFNMTTELKDKK
QKVHALFYKLDIVQINSSEYRLINCNTSVIKQACPKISFDPIPIHYCTPAGYAILKCNDKNFNGTGPCKNVSSVQCTHGIKPVVS
TQLLLNGSLAEEEIIIRSENLTNNAKTIIVHLNKSVEINCTRPSNNTRTSITMGPGQVFYRTGDIIGDIRKAYCEINGIKWNEVL
VQVTGKLKEHFNKTIIFQPPSGGDLEIITHHFSCRGEFFYCNTTKLFNNTCIGNTSMEGCNNTIILPCKIKQIINMWQGVGQAMY
APPISGRINCVSNITGILLTRDGGADNNTTNETFRPGGGNIKDNWRSELYKYKVVEIEPLGIAPTRARTLTVQARQLLSGIVQQQ
SNLLRAIEAQQHLLQLTVWGIKQLQARVLAVERYLKDQKFLGLWGCSGKIICTTAVPWNSSWSNKSFEEIWDNMTWIEWEREISN
YTSQIYEILTESQNQQDRNEKDLLELDKWASLWNW*

*Amino acids seen in blue color is for easy identification of the junction of the deleted fusion cleavage site.

Fig. 37C

CODON-OPTIMIZED 97CNGX2F-AE 140CF.seq (1921 nt.)

Nick name: 018 ttcagtcgacagccaccATGCGAGTAAAAGAGACACAAATGAATTGGCCCAATTTGTGGAAGTGGGGAACATTGATCCTGGGACT
GGTGATAATCTGTAGTGCATCCGACAATCTCTGGGTGACCGTTTACTATGGTGTACCAGTTTGGAGAGACGCTGATACCACCCTC
TTCTGTGCAAGCGACGCCAAAGCCCACGAAACTGAAGTCCATAATGTATGGGCCACCCACGCGTGCGTACCAACCGACCCTAATC
CCCAAGAGATCCACCTTGAGAATGTAACTGAGAATTTTAACATGTGGAGAAATAACATGGTGGAACAAATGCAGGAAGACGTTAT
TTCCTTGTGGGACCAGAGCCTTAAACCTTGTGTCAAATTGACTCCCCTGTGTGTGACTCTCAATTGTACAAACGCAAATTGGACC
AACAGCAACAACACTACCAACGGCCCTAACAAAATTGGCAATATTACTGATGAAGTCAAGAACTGCACTTTTAACATGACAACAG
AACTGAAGGATAAGAAACAGAAAGTCCATGCTCTGTTCTATAAGCTCGACATAGTACAAATTAATAGCTCAGAATATAGACTGAT
AAACTGCAATACTTCCGTTATCAAACAGGCCTGTCCAAAGATAAGCTTCGATCCCATCCCTATTCACTACTGCACACCAGCCGGT
TACGCTATCCTGAAATGCAACGATAAGAATTTTAACGGCACAGGTCCCTGCAAAAACGTTTCCTCTGTCCAGTGTACACACGGTA
TCAAGCCTGTAGTATCAACACAACTGCTCCTGAATGGCTCCTTGGCCGAAGAAGAGATCATCATTAGAAGTGAGAACCTGACGAA
CAACGCCAAGACTATAATAGTGCACCTCAATAAATCTGTAGAAATCAACTGTACCCGACCCTCAAACAACACTCGAACAAGTATA
ACAATGGGCCCTGGCCAAGTTTTTACCGGACCGGCGACATAATAGGCGATATCAGAAAGGCATATTGCGAGATCAATGGCATCA
AGTGGAACGAAGTACTGGTTCAAGTAACTGGAAAACTCAAAGAACATTTTAATAAGACCATAATATTCCAGCCCCCGAGTGGCGG
CGACCTCGAGATTATCACCCATCACTTTTCTTGTAGAGGCGAATTTTTTTACTGTAACACGACCAAGCTCTTCAATAACACGTGC
ATCGGGAACACTTCTATGGAAGGATGTAATAATACCATTATACTGCCCTGTAAGATCAAGCAGATTATCAACATGTGGCAGGGAG
TAGGTCAGGCAATGTACGCACCACCGATTTCAGGACGGATCAATTGCGTATCAAATATCACCGGCATTCTGCTGACCCGGGACGG
AGGCGCAGACAACAATACCACTAACGAGACATTTAGACCTGGAGGCGGCAATATAAAGGATAATTGGAGAAGTGAGCTGTATAAA
TACAAAGTCGTAGAGATCGAACCCCTCGGCATTGCTCCAACCCGGGCCCGGACTCTCACCGTACAAGCTAGACAGCTGCTTTCTG
GCATAGTCCAACAGCAGTCAAACCTCCTCCGCGCTATTGAAGCACAACAACACCTGCTCCAGCTGACTGTGTGGGGAATCAAACA
ATTGCAAGCAAGAGTGCTCGCCGTGGAACGCTATTTGAAAGATCAGAAATTTCTTGGACTTTGGGGCTGCAGCGGCAAAATTATT
TGTACAACAGCGGTGCCTTGGAACTCATCCTGGAGTAATAAAAGCTTTGAAGAAATCTGGGACAATATGACATGGATTGAGTGGG
AGAGAGAGATTTCAAACTATACAAGCCAAATTTACGAAATACTGACAGAAAGTCAAAACCAGCAGGACAGAAATGAGAAAGACCT
GCTCGAACTGGATAAGTGGGCCTCTTTGTGGAACTGGtaaagatcttacaa

Fig. 38A

Wild-type DRCBL-G (854a.a.)

MRVKGIQRNWQHLWNWGILILGLVIICSAEKLWVTVYYGVPVWEDANAPLFCASDAKAHSTESHNIWATHACVPTDPSPQEINMR
NVTENFNMWKNNMVEQMHEDIISLWDESLKPCVKLTPLCVTLNCTEINNNSTRNITEEYRMTNCSFNMTTELRDKKKAEYALFYR
TDVVPINEMNNENNGTNSTWYRLTNCNVSTIKQACPKVTFEPIPIHYCAPAGFAILKCVDKKFNGTGTCNNVSTVQCTHGIKPVV
STQLLLNGSLAEKDIIISSENISDNAKVIIVHLNRSVEINCTRPNNNTRRSVAIGPGQAFYTTGEVIGDIRKAHCNVSWTKWNET
LRDVQAKLQEYFINKSIEFNSSSGGDLEITTHSFNCGGEFFYCNTSGLFNNSILKSNISENNDTITLNCKIKQIVRMWQRVGQAM
YAPPIAGNITCRSNITGLILTRDGGDNNSTSEIFRPGGGDMKNNWRSELYKYKTVKIKSLGIAPTRARRRVVEREKRAVGVGAIF
LGFLGTAGSTMGAASITLTVQVRQLLSGIVQQQSNLLRAIEAQQHLLQLTVWGIKQLRARVLALERYLKDQQLLGIWGCSGKLIC
TTNVPWNTSWSNKSYNEIWENMTWIEWEREIDNYTYHIYSLIEQSQIQQEKNEQDLLALDQWASLWSWFSISNWLWYIRIFVMIV
GGLIGLRIVFAVLSIVNRVRQGYSPLSFQTLLHHQREPDRPAGIEEGGGEQDRDRSIRLVSGFLALAWDDLRSLCLFSYHRLRDF
ILIAARTVELLGRNSLKGLRLGWEALKYLWNLLLYWARELKNSAINLLDTIAIAVANWTDRVIEVAQRAGRAVLNIPRRIRQGLE
RALL

*Amino acid sequence underlined is the fusion domain that will be deleted in 140CF design and the "W" underlined with red color is the last amino acid at the C terminus, and all the remaining amino acids after the "W" will be deleted in 140CF design.

Fig. 38B

DRCBL-G 140CF.pep (630 a.a.)

Nick name: 017

MRVKGIQRNWQHLWNWGILILGLVIICSAEKLWVTVYYGVPVWEDANAPLFCASDAKAHSTESHNIWATHACVPTDPSPQEINMR
NVTENFNMWKNNMVEQMHEDIISLWDESLKPCVKLTPLCVTLNCTEINNNSTRNITEEYRMTNCSFNMTTELRDKKKAEYALFYR
TDVVPINEMNNENNGTNSTWYRLTNCNVSTIKQACPKVTFEPIPIHYCAPAGFAILKCVDKKFNGTGTCNNVSTVQCTHGIKPVV
STQLLLNGSLAEKDIIISSENISDNAKVIIVHLNRSVEINCTRPNNNTRRSVAIGPGQAFYTTGEVIGDIRKAHCNVSWTKWNET
LRDVQAKLQEYFINKSIEFNSSSGGDLEITTHSFNCGGEFFYCNTSGLFNNSILKSNISENNDTITLNCKIKQIVRMWQRVGQAM
YAPPIAGNITCRSNITGLILTRDGGDNNSTSEIFRPGGGDMKNNWRSELYKYKTVKIKSLGIAPTRARTLTVQVRQLLSGIVQQQ
SNLLRAIEAQQHLLQLTVWGIKQLRARVLALERYLKDQQLLGIWGCSGKLICTTNVPWNTSWSNKSYNEIWENMTWIEWEREIDN
YTYHIYSLIEQSQIQQEKNEQDLLALDQWASLWSW*

*Amino acids seen in blue color is for easy identification of the junction of the deleted fusion cleavage site.

Fig. 38C

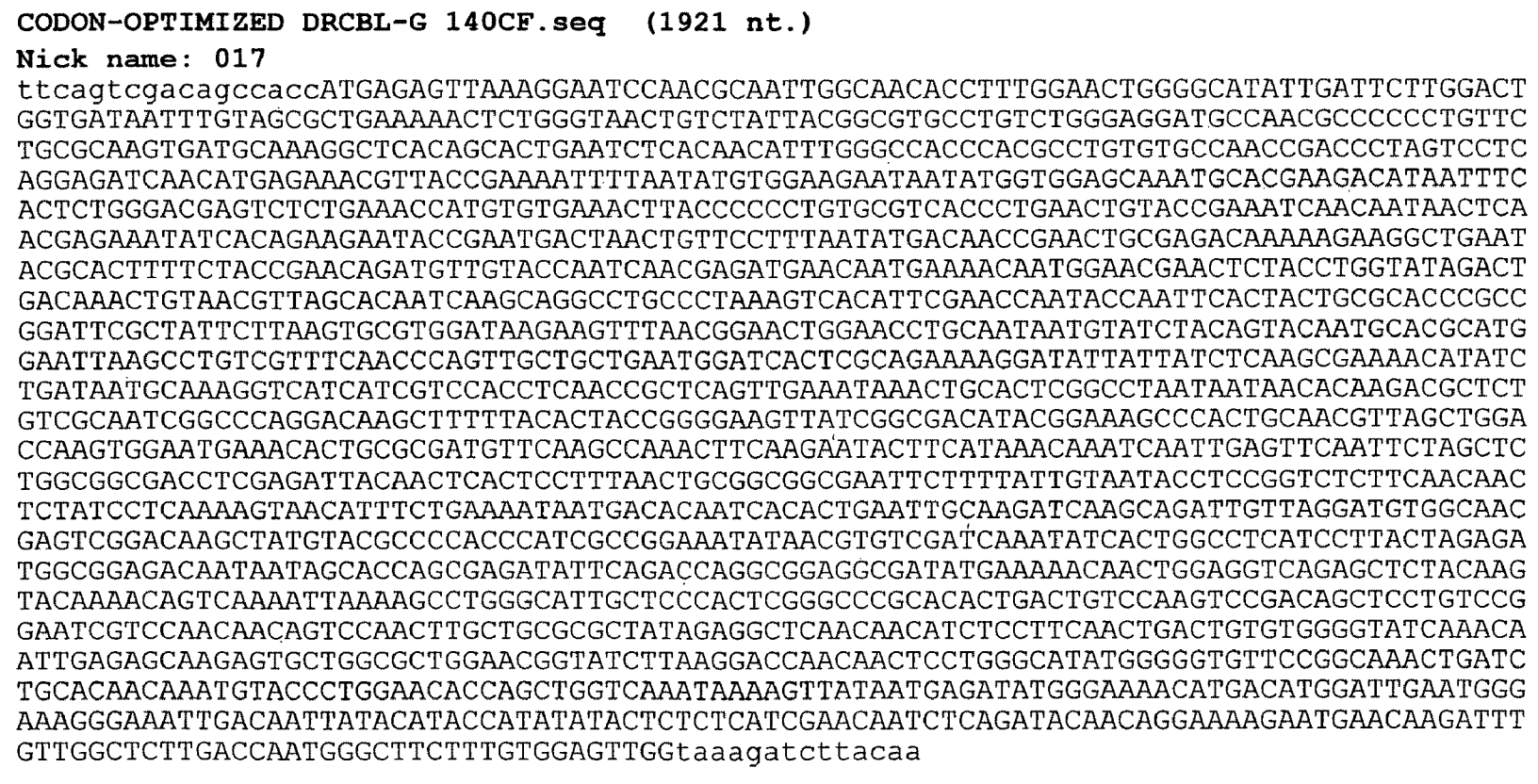

CODON-OPTIMIZED DRCBL-G 140CF.seq (1921 nt.)

Nick name: 017 ttcagtcgacagccaccATGAGAGTTAAAGGAATCCAACGCAATTGGCAACACCTTTGGAACTGGGGCATATTGATTCTTGGACT
GGTGATAATTTGTAGCGCTGAAAAACTCTGGGTAACTGTCTATTACGGCGTGCCTGTCTGGGAGGATGCCAACGCCCCCCTGTTC
TGCGCAAGTGATGCAAAGGCTCACAGCACTGAATCTCACAACATTTGGGCCACCCACGCCTGTGTGCCAACCGACCCTAGTCCTC
AGGAGATCAACATGAGAAACGTTACCGAAAATTTTAATATGTGGAAGAATAATATGGTGGAGCAAATGCACGAAGACATAATTTC
ACTCTGGGACGAGTCTCTGAAACCATGTGTGAAACTTACCCCCCTGTGCGTCACCCTGAACTGTACCGAAATCAACAATAACTCA
ACGAGAAATATCACAGAAGAATACCGAATGACTAACTGTTCCTTTAATATGACAACCGAACTGCGAGACAAAAAGAAGGCTGAAT
ACGCACTTTTCTACCGAACAGATGTTGTACCAATCAACGAGATGAACAATGAAAACAATGGAACGAACTCTACCTGGTATAGACT
GACAAACTGTAACGTTAGCACAATCAAGCAGGCCTGCCCTAAAGTCACATTCGAACCAATACCAATTCACTACTGCGCACCCGCC
GGATTCGCTATTCTTAAGTGCGTGGATAAGAAGTTTAACGGAACTGGAACCTGCAATAATGTATCTACAGTACAATGCACGCATG
GAATTAAGCCTGTCGTTTCAACCCAGTTGCTGCTGAATGGATCACTCGCAGAAAAGGATATTATTATCTCAAGCGAAAACATATC
TGATAATGCAAAGGTCATCATCGTCCACCTCAACCGCTCAGTTGAAATAAACTGCACTCGGCCTAATAATAACACAAGACGCTCT
GTCGCAATCGGCCCAGGACAAGCTTTTACACTACCGGGGAAGTTATCGGCGACATACGGAAAGCCCACTGCAACGTTAGCTGGA
CCAAGTGGAATGAAACACTGCGCGATGTTCAAGCCAAACTTCAAGAATACTTCATAAACAAATCAATTGAGTTCAATTCTAGCTC
TGGCGGCGACCTCGAGATTACAACTCACTCCTTTAACTGCGGCGGCGAATTCTTTTATTGTAATACCTCCGGTCTCTTCAACAAC
TCTATCCTCAAAAGTAACATTTCTGAAAATAATGACACAATCACACTGAATTGCAAGATCAAGCAGATTGTTAGGATGTGGCAAC
GAGTCGGACAAGCTATGTACGCCCCACCCATCGCCGGAAATATAACGTGTCGATCAAATATCACTGGCCTCATCCTTACTAGAGA
TGGCGGAGACAATAATAGCACCAGCGAGATATTCAGACCAGGCGGAGGCGATATGAAAAACAACTGGAGGTCAGAGCTCTACAAG
TACAAAACAGTCAAAATTAAAGCCTGGGCATTGCTCCCACTCGGGCCCGCACACTGACTGTCCAAGTCCGACAGCTCCTGTCCG
GAATCGTCCAACAACAGTCCAACTTGCTGCGCGCTATAGAGGCTCAACAACATCTCCTTCAACTGACTGTGTGGGGTATCAAACA
ATTGAGAGCAAGAGTGCTGGCGCTGGAACGGTATCTTAAGGACCAACAACTCCTGGGCATATGGGGGTGTTCCGGCAAACTGATC
TGCACAACAAATGTACCCTGGAACACCAGCTGGTCAAATAAAAGTTATAATGAGATATGGGAAAACATGACATGGATTGAATGGG
AAAGGGAAATTGACAATTATACATACCATATATACTCTCTCATCGAACAATCTCAGATACAACAGGAAAAGAATGAACAAGATTT
GTTGGCTCTTGACCAATGGGCTTCTTTGTGGAGTTGGtaaagatcttacaa

2003 Centralized HIV-1 Envelope Proteins and the Codon-Optimized Gene sequences

*Fig. 39A*

2003 Cons Env

MRVMGIQRNCQHLWRWGILIFGMLIICSAAENLWVTVYYGVPVWKEANTTLFCASDAKAYDTEVHNVWATHACVPTDPNPQEIVLENVTENF
NMWKNNMVEQMHEDIISLWDQSLKPCVKLTPLCVTLNCTDVNATNNTTNNEEIKNCSFNITTEIRDKKKKVYALFYKLDVVPIDDNNSYRLI
NCNTSAITQACPKVSFEPIPIHYCAPAGFAILKCNDKKFNGTGPCKNVSTVQCTHGIKPVVSTQLLLNGSLAEEEIIIRSENITNNAKTIIV
QLNESVEINCTRPNNNTRKSIRIGPGQAFYATGDIIGDIRQAHCNISRTKWNKTLQQVAKKLREHFNKTIIFNPSSGGDLEITTHSFNCGGE
FFYCNTSELFNSTWNGTNNTITLPCRIKQIINMWQGVGQAMYAPPIEGKIRCTSNITGLLLTRDGGNNNTETFRPGGGDMRDNWRSELYKYK
VVKIEPLGVAPTKAKRRVVEREKRAVGIGAVFLGFLGAAGSTMGAASITLTVQARQLLSGIVQQQSNLLRAIEAQQHLLQLTVWGIKQLQAR
VLAVERYLKDQQLLGIWGCSGKLICTTNVPWNSSWSNKSQDEIWDNMTWMEWDKEINNYTDIIYSLIEESQNQQEKNEQELLALDKWASLWN
WFDITNWLWYIKIFIMIVGGLIGLRIVFAVLSIVNRVRQGYSPLSFQTLIPNPRGPDRPEGIEEEGGEQDRDRSIRLVNGFLALAWDDLRSL
CLFSYHRLRDLILIAARTVELLGRRGWEALKYLWNLLQYWGQELKNSAISLLDTTAIAVAEGTDRVIEVVQRVCRAILNIPRRIRQGFERAL
LS

*Fig. 40A*

2003 M. Group.AnC Env

MRVMGIQRNCQHLWRWGILIFGMLMICSAAENLWVTVYYGVPVWKEANTTLFCASDAKAYDTEVHNVWATHACVPTDPNPQEIVLENVTENF
NMWKNNMVEQMHEDIISLWDQSLKPCVKLTPLCVTLNCTDVNATNNSTNMGEIKNCSFNITTEIRDKKQKVYALFYRLDVVPINDNNSYRLI
NCNTSAITQACPKVSFEPIPIHYCAPAGFAILKCNDKKFNGTGPCKNVSTVQCTHGIKPVVSTQLLLNGSLAEEEIIIRSENITDNAKTIIV
QLNESVEINCTRPNNNTRKSIRIGPGQAFYATGDIIGDIRQAHCNISGAEWNKTLQQVAAKLREHFNNKTIIFKPSSGGDLEITTHSFNCGG
EFFYCNTSGLFNSTWNGTNETITLPCRIKQIVNMWQRVGQAMYAPPIAGNITCKSNITGLLLTRDGGTNNTETFRPGGGDMRDNWRSELYKY
KVVKIEPLGVAPTKAKRRVVEREKRAVGIGAVFLGFLGAAGSTMGAASITLTVQARQLLSGIVQQQSNLLRAIEAQQHLLQLTVWGIKQLQA
RVLAVERYLKDQQLLGIWGCSGKLICTTNVPWNSSWSNKSQDEIWDNMTWMQWEREISNYTDIIYSLIEESQNQQEKNEQDLLALDKWASLW
NWFDITNWLWYIKIFIMIVGGLIGLRIVFAVLSIVNRVRQGYSPLSFQTLIPNPRGPDRPGGIEEEGGEQDRDRSIRLVSGFLALAWDDLRS
LCLFSYHRLRDFILIAARTVELLGRRGWEALKYLWNLLQYWGQELKNSAISLLDTTAIAVAEGTDRVIEVVQRACRAILHIPRRIRQGFERA
LL$

Fig. 39B

2003 CON-S Env.seq.opt

ATGCGCGTGATGGGCATCCAGCGCAACTGCCAGCACCTGTGGCGCTGGGGCATCCTGATCTTCGGCATGCTGATCATCTGCTCCGCCGCCGA
GAACCTGTGGGTGACCGTGTACTACGGCGTGCCCGTGTGGAAGGAGGCCAACACCACCCTGTTCTGCGCCTCCGACGCCAAGGCCTACGACA
CCGAGGTGCACAACGTGTGGGCCACCCACGCCTGCGTGCCCACCGACCCCAACCCCCAGGAGATCGTGCTGGAGAACGTGACCGAGAACTTC
AACATGTGGAAGAACAACATGGTGGAGCAGATGCACGAGGACATCATCTCCCTGTGGGACCAGTCCCTGAAGCCCTGCGTGAAGCTGACCCC
CCTGTGCGTGACCCTGAACTGCACCGACGTGAACGCCACCAACAACACCACCAACAACGAGGAGATCAAGAACTGCTCCTTCAACATCACCA
CCGAGATCCGCGACAAGAAGAAGAAGGTGTACGCCCTGTTCTACAAGCTGGACGTGGTGCCCATCGACGACAACAACTCCTACCGCCTGATC
AACTGCAACACCTCCGCCATCACCCAGGCCTGCCCCAAGGTGTCCTTCGAGCCCATCCCCATCCACTACTGCGCCCCCGCCGGCTTCGCCAT
CCTGAAGTGCAACGACAAGAAGTTCAACGGCACCGGCCCCTGCAAGAACGTGTCCACCGTGCAGTGCACCCACGGCATCAAGCCCGTGGTGT
CCACCCAGCTGCTGCTGAACGGCTCCCTGGCCGAGGAGGAGATCATCATCCGCTCCGAGAACATCACCAACAACGCCAAGACCATCATCGTG
CAGCTGAACGAGTCCGTGGAGATCAACTGCACCCGCCCCAACAACAACACCCGCAAGTCCATCCGCATCGGCCCCGGCCAGGCCTTCTACGC
CACCGGCGACATCATCGGCGACATCCGCCAGGCCCACTGCAACATCTCCCGCACCAAGTGGAACAAGACCCTGCAGCAGGTGGCCAAGAAGC
TGCGCGAGCACTTCAACAAGACCATCATCTTCAACCCCTCCTCCGGCGGCGACCTGGAGATCACCACCCACTCCTTCAACTGCGGCGGCGAG
TTCTTCTACTGCAACACCTCCGAGCTGTTCAACTCCACCTGGAACGGCACCAACAACACCATCACCCTGCCCTGCCGCATCAAGCAGATCAT
CAACATGTGGCAGGGCGTGGGCCAGGCCATGTACGCCCCCCCCATCGAGGGCAAGATCCGCTGCACCTCCAACATCACCGGCCTGCTGCTGA
CCCGCGACGGCGGCAACAACAACACCGAGACCTTCCGCCCCGGCGGCGGCGACATGCGCGACAACTGGCGCTCCGAGCTGTACAAGTACAAG
GTGGTGAAGATCGAGCCCCTGGGCGTGGCCCCCACCAAGGCCAAGCGCCGCGTGGTGGAGCGCGAGAAGCGCGCCGTGGGCATCGGCGCCGT
GTTCCTGGGCTTCCTGGGCGCCGCCGGCTCCACCATGGGCGCCGCCTCCATCACCCTGACCGTGCAGGCCCGCCAGCTGCTGTCCGGCATCC
TGCAGCAGCAGTCCAACCTGCTGCGCGCCATCGAGGCCCAGCAGCACCTGCTGCAGCTGACCGTGTGGGGCATCAAGCAGCTGCAGGCCCGC
GTGCTGGCCGTGGAGCGCTACCTGAAGGACCAGCAGCTGCTGGGCATCTGGGGCTGCTCCGGCAAGCTGATCTGCACCACCAACGTGCCCTG
GAACTCCTCCTGGTCCAACAAGTCCCAGGACGAGATCTGGGACAACATGACCTGGATGGAGTGGGACAAGGAGATCAACAACTACACCGACA
TCATCTACTCCCTGATCGAGGAGTCCCAGAACCAGCAGGAGAAGAACGAGCAGGAGCTGCTGGCCCTGGACAAGTGGGCCTCCCTGTGGAAC
TGGTTCGACATCACCAACTGGCTGTGGTACATCAAGATCTTCATCATGATCGTGGGCGGCCTGATCGGCCTGCGCATCGTGTTCGCCGTGCT
GTCCATCGTGAACCGCGTGCGCCAGGGCTACTCCCCCCTGTCCTTCCAGACCCTGATCCCCAACCCCCGCGGCCCCGACCGCCCCGAGGGCA
TCGAGGAGGAGGGCGGCGAGCAGGACCGCGACCGCTCCATCCGCCTGGTGAACGGCTTCCTGGCCCTGGCCTGGGACGACCTGCGCTCCCTG
TGCCTGTTCTCCTACCACCGCCTGCGCGACCTGATCCTGATCGCCGCCCGCACCGTGGAGCTGCTGGGCCGCCGCGGCTGGGAGGCCCTGAA
GTACCTGTGGAACCTGCTGCAGTACTGGGGCCAGGAGCTGAAGAACTCCGCCATCTCCCTGCTGGACACCACCGCCATCGCCGTGGCCGAGG
GCACCGACCGCGTGATCGAGGTGGTGCAGCGCGTGTGCCGCGCCATCCTGAACATCCCCCGCCGCATCCGCCAGGGCTTCGAGCGCGCCCTG
CTGTAA

Fig. 40B

2003 M. Group.anc Env.seq.opt

ATGCGCGTGATGGGCATCCAGCGCAACTGCCAGCACCTGTGGCGCTGGGGCATCCTGATCTTCGGCATGCTGATGATCTGCTCCGCCGCCGA
GAACCTGTGGGTGACCGTGTACTACGGCGTGCCCGTGTGGAAGGAGGCCAACACCACCCTGTTCTGCGCCTCCGACGCCAAGGCCTACGACA
CCGAGGTGCACAACGTGTGGGCCACCCACGCCTGCGTGCCCACCGACCCCAACCCCCAGGAGATCGTGCTGGAGAACGTGACCGAGAACTTC
AACATGTGGAAGAACAACATGGTGGAGCAGATGCACGAGGACATCATCTCCCTGTGGGACCAGTCCCTGAAGCCCTGCGTGAAGCTGACCCC
CCTGTGCGTGACCCTGAACTGCACCGACGTGAACGCCACCAACAACTCCACCAACATGGGCGAGATCAAGAACTGCTCCTTCAACATCACCA
CCGAGATCCGCGACAAGAAGCAGAAGGTGTACGCCCTGTTCTACCGCCTGGACGTGGTGCCCATCAACGACAACAACTCCTACCGCCTGATC
AACTGCAACACCTCCGCCATCACCCAGGCCTGCCCCAAGGTGTCCTTCGAGCCCATCCCCATCCACTACTGCGCCCCCGCCGGCTTCGCCAT
CCTGAAGTGCAACGACAAGAAGTTCAACGGCACCGGCCCCTGCAAGAACGTGTCCACCGTGCAGTGCACCCACGGCATCAAGCCCGTGGTGT
CCACCCAGCTGCTGCTGAACGGCTCCCTGGCCGAGGAGGAGATCATCATCCGCTCCGAGAACATCACCGACAACGCCAAGACCATCATCGTG
CAGCTGAACGAGTCCGTGGAGATCAACTGCACCCGCCCCAACAACAACACCCGCAAGTCCATCCGCATCGGCCCCGGCCAGGCCTTCTACGC
CACCGGCGACATCATCGGCGACATCCGCCAGGCCCACTGCAACATCTCCGGCGCCGAGTGGAACAAGACCCTGCAGCAGGTGGCCGCCAAGC
TGCGCGAGCACTTCAACAACAAGACCATCATCTTCAAGCCCTCCTCCGGCGGCGACCTGGAGATCACCACCCACTCCTTCAACTGCGGCGGC
GAGTTCTTCTACTGCAACACCTCCGGCCTGTTCAACTCCACCTGGAACGGCACCAACGAGACCATCACCCTGCCCTGCCGCATCAAGCAGAT
CGTGAACATGTGGCAGCGCGTGGGCCAGGCCATGTACGCCCCCCCCATCGCCGGCAACATCACCTGCAAGTCCAACATCACCGGCCTGCTGC
TGACCCGCGACGGCGGCACCAACAACACCGAGACCTTCCGCCCCGGCGGCGGCGACATGCGCGACAACTGGCGCTCCGAGCTGTACAAGTAC
AAGGTGGTGAAGATCGAGCCCCTGGGCGTGGCCCCCACCAAGGCCAAGCGCCGCGTGGTGGAGCGCGAGAAGCGCGCCGTGGGCATCGGCGC
CGTGTTCCTGGGCTTCCTGGGCGCCGCCGGCTCCACCATGGGCGCCGCCTCCATCACCCTGACCGTGCAGGCCCGCCAGCTGCTGTCCGGCA
TCGTGCAGCAGCAGTCCAACCTGCTGCGCGCCATCGAGGCCCAGCAGCACCTGCTGCAGCTGACCGTGTGGGGCATCAAGCAGCTGCAGGCC
CGCGTGCTGGCCGTGGAGCGCTACCTGAAGGACCAGCAGCTGCTGGGCATCTGGGGCTGCTCCGGCAAGCTGATCTGCACCACCAACGTGCC
CTGGAACTCCTCCTGGTCCAACAAGTCCCAGGACGAGATCTGGGACAACATGACCTGGATGCAGTGGGAGCGCGAGATCTCCAACTACACCG
ACATCATCTACTCCCTGATCGAGGAGTCCCAGAACCAGCAGGAGAAGAACGAGCAGGACCTGCTGGCCCTGGACAAGTGGGCCTCCCTGTGG
AACTGGTTCGACATCACCAACTGGCTGTGGTACATCAAGATCTTCATCATGATCGTGGGCGGCCTGATCGGCCTGCGCATCGTGTTCGCCGT
GCTGTCCATCGTGAACCGCGTGCGCCAGGGCTACTCCCCCCTGTCCTTCCAGACCCTGATCCCCAACCCCCGCGGCCCCGACCGCCCCGGCG
GCATCGAGGAGGAGGGCGGCGAGCAGGACCGCGACCGCTCCATCCGCCTGGTGTCCGGCTTCCTGGCCCTGGCCTGGGACGACCTGCGCTCC
CTGTGCCTGTTCTCCTACCACCGCCTGCGCGACTTCATCCTGATCGCCGCCCGCACCGTGGAGCTGCTGGGCCGCCGCGGCTGGGAGGCCCT
GAAGTACCTGTGGAACCTGCTGCAGTACTGGGGCCAGGAGCTGAAGAACTCCGCCATCTCCCTGCTGGACACCACCGCCATCGCCGTGGCCG
AGGGCACCGACCGCGTGATCGAGGTGGTGCAGCGCGCCTGCCGCGCCATCCTGCACATCCCCCGCCGCATCCGCCAGGGCTTCGAGCGCGCC
CTGCTGTAA

Fig. 41A

2003 CON_A1 Env

MRVMGIQRNCQHLLRWGTMILGMIIICSAAENLWVTVYYGVPVWKDAETTLFCASDAKAYETEMHNVWATHACVPTDPNPQEIHLENVTEEF
NMWKNNMVEQMHTDIISLWDQSLKPCVKLTPLCVTLNCSNVNVTNNTTNTHEEEIKNCSFNMTTELRDKKQKVYSLFYRLDVVQINENNSNS
SYRLINCNTSAITQACPKVSFEPIPIHYCAPAGFAILKCKDKEFNGTGPCKNVSTVQCTHGIKPVVSTQLLLNGSLAEEEVIIRSENITNNA
KTIIVQLTKPVKINCTRPNNNTRKSIRIGPGQAFYATGDIIGDIRQAHCNVSRSEWNKTLQKVAKQLRKYFKNKTIIFTNSSGGDLEITTHS
FNCGGEFFYCNTSGLFNSTWNNGTMKNTITLPCRIKQIINMWQRAGQAMYAPPIQGVIRCESNITGLLLTRDGGNNNTNETFRPGGGDMRDN
WRSELYKYKVVKIEPLGVAPTRAKRRVVEREKRAVGIGAVFLGFLGAAGSTMGAASITLTVQARQLLSGIVQQQSNLLRAIEAQQHLLKLTV
WGIKQLQARVLAVERYLKDQQLLGIWGCSGKLICTTNVPWNSSWSNKSQNEIWDNMTWLQWDKEISNYTHIIYNLIEESQNQQEKNEQDLLA
LDKWANLWNWFDISNWLWYIKIFIMIVGGLIGLRIVFAVLSVINRVRQGYSPLSFQTHTPNPRGLDRPGRIEEEGGEQGRDRSIRLVSGFLA
LAWDDLRSLCLFSYHRLRDFILIAARTVELLGHSSLKGLRLGWEGLKYLWNLLLYWGRELKISAINLVDTIAIAVAGWTDRVIEIGQRIGRA
ILHIPRRIRQGLERALL$

Fig. 42A

2003 A1.AnC Env

MRVMGIQRNCQHLWRWGTMIFGMIIICSAAENLWVTVYYGVPVWKDAETTLFCASDAKAYDTEVHNVWATHACVPTDPNPQEIDLENVTEEF
NMWKNNMVEQMHADIISLWDQSLKPCVKLTPLCVTLNCSNVNVTNNTTNTHEEEIKNCSFNMTTELRDKKQKVYSLFYRLDVVPINENNSNS
SYRLINCNTSAITQACPKVSFEPIPIHYCAPAGFAILKCKDKEFNGTGPCKNVSTVQCTHGIKPVVSTQLLLNGSLAEEEVMIRSENITDNA
KTIIVQLTEPVKINCTRPNNNTRKSIRIGPGQAFYATGDIIGDIRQAHCNVSRTEWNKTLQKVAAQLRKHFNNKTIIFNSSSGGDLEITTHS
FNCGGEFFYCNTSGLFNSTWNNGTMKDTITLPCRIKQIINMWQRVGQAMYAPPIQGVIRCESNITGLLLTRDGGNNNTNETFRPGGGDMRDN
WRSELYKYKVVKIEPLGVAPTRAKRRVVEREKRAVGLGAVFLGFLGAAGSTMGAASITLTVQARQLLSGIVQQQSNLLRAIEAQQHLLKLTV
WGIKQLQARVLAVERYLKDQQLLGIWGCSGKLICTTNVPWNSSWSNKSQDEIWDNMTWLQWDKEISNYTDIIYNLIEESQNQQEKNEQDLLA
LDKWANLWNWFDISNWLWYIKIFIMIVGGLIGLRIVFAVLSVINRVRQGYSPLSFQTLTPNPEGPDRPGRIEEEGGEQGRDRSIRLVSGFLA
LAWDDLRSLCLFSYHRLRDFILIAARTVELLGRSSLKGLRLGWEGLKYLWNLLLYWGRELKISAINLLDTIAIAVAGWTDRVIEIGQRICRA
ILNIPRRIRQGLERALL$

Fig. 41B

2003 CON_A1 Env.seq.opt

ATGCGCGTGATGGGCATCCAGCGCAACTGCCAGCACCTGCTGCGCTGGGGCACCATGATCCTGGGCATGATCATCATCTGCTCCGCCGCCGA
GAACCTGTGGGTGACCGTGTACTACGGCGTGCCCGTGTGGAAGGACGCCGAGACCACCCTGTTCTGCGCCTCCGACGCCAAGGCCTACGAGA
CCGAGATGCACAACGTGTGGGCCACCCACGCCTGCGTGCCCACCGACCCCAACCCCCAGGAGATCCACCTGGAGAACGTGACCGAGGAGTTC
AACATGTGGAAGAACAACATGGTGGAGCAGATGCACACCGACATCATCTCCCTGTGGGACCAGTCCCTGAAGCCCTGCGTGAAGCTGACCCC
CCTGTGCGTGACCCTGAACTGCTCCAACGTGAACGTGACCAACAACACCACCAACACCCACGAGGAGGAGATCAAGAACTGCTCCTTCAACA
TGACCACCGAGCTGCGCGACAAGAAGCAGAAGGTGTACTCCCTGTTCTACCGCCTGGACGTGGTGCAGATCAACGAGAACAACTCCAACTCC
TCCTACCGCCTGATCAACTGCAACACCTCCGCCATCACCCAGGCCTGCCCCAAGGTGTCCTTCGAGCCCATCCCCATCCACTACTGCGCCCC
CGCCGGCTTCGCCATCCTGAAGTGCAAGGACAAGGAGTTCAACGGCACCGGCCCCTGCAAGAACGTGTCCACCGTGCAGTGCACCCACGGCA
TCAAGCCCGTGGTGTCCACCCAGCTGCTGCTGAACGGCTCCCTGGCCGAGGAGGAGGTGATCATCCGCTCCGAGAACATCACCAACAACGCC
AAGACCATCATCGTGCAGCTGACCAAGCCCGTGAAGATCAACTGCACCCGCCCCAACAACAACACCCGCAAGTCCATCCGCATCGGCCCCGG
CCAGGCCTTCTACGCCACCGGCGACATCATCGGCGACATCCGCCAGGCCCACTGCAACGTGTCCCGCTCCGAGTGGAACAAGACCCTGCAGA
AGGTGGCCAAGCAGCTGCGCAAGTACTTCAAGAACAAGACCATCATCTTCACCAACTCCTCCGGCGGCGACCTGGAGATCACCACCCACTCC
TTCAACTGCGGCGGCGAGTTCTTCTACTGCAACACCTCCGGCCTGTTCAACTCCACCTGGAACAACGGCACCATGAAGAACACCATCACCCT
GCCCTGCCGCATCAAGCAGATCATCAACATGTGGCAGCGCGCCGGCCAGGCCATGTACGCCCCCCCCATCCAGGGCGTGATCCGCTGCGAGT
CCAACATCACCGGCCTGCTGCTGACCCGCGACGGCGGCAACAACAACACCAACGAGACCTTCCGCCCCGGCGGCGGCGACATGCGCGACAAC
TGGCGCTCCGAGCTGTACAAGTACAAGGTGGTGAAGATCGAGCCCCTGGGCGTGGCCCCCACCCGCGCCAAGCGCCGCGTGGTGGAGCGCGA
GAAGCGCGCCGTGGGCATCGGCGCCGTGTTCCTGGGCTTCCTGGGCGCCGCCGGCTCCACCATGGGCGCCGCCTCCATCACCCTGACCGTGC
AGGCCCGCCAGCTGCTGTCCGGCATCGTGCAGCAGCAGTCCAACCTGCTGCGCGCCATCGAGGCCCAGCAGCACCTGCTGAAGCTGACCGTG
TGGGGCATCAAGCAGCTGCAGGCCCGCGTGCTGGCCGTGGAGCGCTACCTGAAGGACCAGCAGCTGCTGGGCATCTGGGGCTGCTCCGGCAA
GCTGATCTGCACCACCAACGTGCCCTGGAACTCCTCCTGGTCCAACAAGTCCCAGAACGAGATCTGGGACAACATGACCTGGCTGCAGTGGG
ACAAGGAGATCTCCAACTACACCCACATCATCTACAACCTGATCGAGGAGTCCCAGAACCAGCAGGAGAAGAACGAGCAGGACCTGCTGGCC
CTGGACAAGTGGGCCAACCTGTGGAACTGGTTCGACATCTCCAACTGGCTGTGGTACATCAAGATCTTCATCATGATCGTGGGCGGCCTGAT
CGGCCTGCGCATCGTGTTCGCCGTGCTGTCCGTGATCAACCGCGTGCGCCAGGGCTACTCCCCCCTGTCCTTCCAGACCCACACCCCCAACC
CCCGCGGCCTGGACCGCCCCGGCCGCATCGAGGAGGAGGGCGGCGAGCAGGGCCGCGACCGCTCCATCCGCCTGGTGTCCGGCTTCCTGGCC
CTGGCCTGGGACGACCTGCGCTCCCTGTGCCTGTTCTCCTACCACCGCCTGCGCGACTTCATCCTGATCGCCGCCCGCACCGTGGAGCTGCT
GGGCCACTCCTCCCTGAAGGGCCTGCGCCTGGGCTGGGAGGGCCTGAAGTACCTGTGGAACCTGCTGCTGTACTGGGGCCGCGAGCTGAAGA
TCTCCGCCATCAACCTGGTGGACACCATCGCCATCGCCGTGGCCGGCTGGACCGACCGCGTGATCGAGATCGGCCAGCGCATCGGCCGCGCC
ATCCTGCACATCCCCCGCCGCATCCGCCAGGGCCTGGAGCGCGCCCTGCTGTAA

Fig. 42B

2003 A1.anc Env.seq.opt

ATGCGCGTGATGGGCATCCAGCGCAACTGCCAGCACCTGTGGCGCTGGGGCACCATGATCTTCGGCATGATCATCATCTGCTCCGCCGCCGA
GAACCTGTGGGTGACCGTGTACTACGGCGTGCCCGTGTGGAAGGACGCCGAGACCACCCTGTTCTGCGCCTCCGACGCCAAGGCCTACGACA
CCGAGGTGCACAACGTGTGGGCCACCCACGCCTGCGTGCCCACCGACCCCAACCCCCAGGAGATCGACCTGGAGAACGTGACCGAGGAGTTC
AACATGTGGAAGAACAACATGGTGGAGCAGATGCACGCCGACATCATCTCCCTGTGGGACCAGTCCCTGAAGCCCTGCGTGAAGCTGACCCC
CCTGTGCGTGACCCTGAACTGCTCCAACGTGAACGTGACCAACAACACCACCAACACCCACGAGGAGGAGATCAAGAACTGCTCCTTCAACA
TGACCACCGAGCTGCGCGACAAGAAGCAGAAGGTGTACTCCCTGTTCTACCGCCTGGACGTGGTGCCCATCAACGAGAACAACTCCAACTCC
TCCTACCGCCTGATCAACTGCAACACCTCCGCCATCACCCAGGCCTGCCCCAAGGTGTCCTTCGAGCCCATCCCCATCCACTACTGCGCCCC
CGCCGGCTTCGCCATCCTGAAGTGCAAGGACAAGGAGTTCAACGGCACCGGCCCCTGCAAGAACGTGTCCACCGTGCAGTGCACCCACGGCA
TCAAGCCCGTGGTGTCCACCCAGCTGCTGCTGAACGGCTCCCTGGCCGAGGAGGAGGTGATGATCCGCTCCGAGAACATCACCGACAACGCC
AAGACCATCATCGTGCAGCTGACCGAGCCCGTGAAGATCAACTGCACCCGCCCCAACAACAACACCCGCAAGTCCATCCGCATCGGCCCCGG
CCAGGCCTTCTACGCCACCGGCGACATCATCGGCGACATCCGCCAGGCCCACTGCAACGTGTCCCGCACCGAGTGGAACAAGACCCTGCAGA
AGGTGGCCGCCCAGCTGCGCAAGCACTTCAACAACAAGACCATCATCTTCAACTCCTCCTCCGGCGGCGACCTGGAGATCACCACCCACTCC
TTCAACTGCGGCGGCGAGTTCTTCTACTGCAACACCTCCGGCCTGTTCAACTCCACCTGGAACAACGGCACCATGAAGGACACCATCACCCT
GCCCTGCCGCATCAAGCAGATCATCAACATGTGGCAGCGCGTGGGCCAGGCCATGTACGCCCCCCCCATCCAGGGCGTGATCCGCTGCGAGT
CCAACATCACCGGCCTGCTGCTGACCCGCGACGGCGGCAACAACAACACCAACGAGACCTTCCGCCCCGGCGGCGGCGACATGCGCGACAAC
TGGCGCTCCGAGCTGTACAAGTACAAGGTGGTGAAGATCGAGCCCCTGGGCGTGGCCCCCACCCGCGCCAAGCGCCGCGTGGTGGAGCGCGA
GAAGCGCGCCGTGGGCCTGGGCGCCGTGTTCCTGGGCTTCCTGGGCGCCGCCGGCTCCACCATGGGCGCCGCCTCCATCACCCTGACCGTGC
AGGCCCGCCAGCTGCTGTCCGGCATCGTGCAGCAGCAGTCCAACCTGCTGCGCGCCATCGAGGCCCAGCAGCACCTGCTGAAGCTGACCGTG
TGGGGCATCAAGCAGCTGCAGGCCCGCGTGCTGGCCGTGGAGCGCTACCTGAAGGACCAGCAGCTGCTGGGCATCTGGGGCTGCTCCGGCAA
GCTGATCTGCACCACCAACGTGCCCTGGAACTCCTCCTGGTCCAACAAGTCCCAGGACGAGATCTGGGACAACATGACCTGGCTGCAGTGGG
ACAAGGAGATCTCCAACTACACCGACATCATCTACAACCTGATCGAGGAGTCCCAGAACCAGCAGGAGAAGAACGAGCAGGACCTGCTGGCC
CTGGACAAGTGGGCCAACCTGTGGAACTGGTTCGACATCTCCAACTGGCTGTGGTACATCAAGATCTTCATCATGATCGTGGGCGGCCTGAT
CGGCCTGCGCATCGTGTTCGCCGTGCTGTCCGTGATCAACCGCGTGCGCCAGGGCTACTCCCCCCTGTCCTTCCAGACCCTGACCCCCAACC
CCGAGGGCCCCGACCGCCCCGGCCGCATCGAGGAGGAGGGCGGCGAGCAGGGCCGCGACCGCTCCATCCGCCTGGTGTCCGGCTTCCTGGCC
CTGGCCTGGGACGACCTGCGCTCCCTGTGCCTGTTCTCCTACCACCGCCTGCGCGACTTCATCCTGATCGCCGCCCGCACCGTGGAGCTGCT
GGGCCGCTCCTCCCTGAAGGGCCTGCGCCTGGGCTGGGAGGGCCTGAAGTACCTGTGGAACCTGCTGCTGTACTGGGGCCGCGAGCTGAAGA
TCTCCGCCATCAACCTGCTGGACACCATCGCCATCGCCGTGGCCGGCTGGACCGACCGCGTGATCGAGATCGGCCAGCGCATCTGCCGCGCC
ATCCTGAACATCCCCCGCCGCATCCGCCAGGGCCTGGAGCGCGCCCTGCTGTAA

Fig. 43A

2003 CON_A2 Env

MRVMGTQRNYQHLWRWGILILGMLIMCKATDLWVTVYYGVPVWKDADTTLFCASDAKAYDTEVHNVWATHACVPTDPNPQEVNLENVTEDFN
MWKNNMVEQMHEDIISLWDQSLKPCVKLTPLCVTLNCSNANTTNNSTMEEIKNCSYNITTELRDKTQKVYSLFYKLDVVQLDESNKSEYYYR
LINCNTSAITQACPKVSFEPIPIHYCAPAGFAILKCKDPRFNGTGSCNNVSSVQCTHGIKPVASTQLLLNGSLAEGKVMIRSENITNNAKNI
IVQFNKPVPITCIRPNNNTRKSIRFGPGQAFYTNDIIGDIRQAHCNINKTKWNATLQKVAEQLREHFPNKTIIFTNSSGGDLEITTHSFNCG
GEFFYCNTTGLFNSTWKNGTTNNTEQMITLPCRIKQIINMWQRVGRAMYAPPIAGVIKCTSNITGIILTRDGGNNETETFRPGGGDMRDNWR
SELYKYKVVKIEPLGVAPTRAKRRVVEREKRAVGMGAVFLGFLGAAGSTMGAASITLTVQARQLLSGIVQQQSNLLKAIEAQQHLLKLTVWG
IKQLQARVLALERYLQDQQLLGIWGCSGKLICATTVPWNSSWSNKTQEEIWNNMTWLQWDKEISNYTNIIYKLLEESQNQQEKNEQDLLALD
KWANLWNWFNITNWLWYIRIFIMIVGGLIGLRIVIAIISVVNRVRQGYSPLSFQIPTPNPEGLDRPGRIEEGGGEQGRDRSIRLVSGFLALA
WDDLRSLCLFSYHRLRDCILIAARTVELLGHSSLKGLRLGWEGLKYLWNLLLYWGRELKNSAISLLDTIAVAVAEWTDRVIEIGQRACRAIL
NIPRRIRQGFERALL$

Fig. 44A

2003 CON_B Env

MRVKGIRKNYQHLWRWGTMLLGMLMICSAAEKLWVTVYYGVPVWKEATTTLFCASDAKAYDTEVHNVWATHACVPTDPNPQEVVLENVTENF
NMWKNNMVEQMHEDIISLWDQSLKPCVKLTPLCVTLNCTDLMNATNTNTTIIYRWRGEIKNCSFNITTSIRDKVQKEYALFYKLDVVPIDND
NTSYRLISCNTSVITQACPKVSFEPIPIHYCAPAGFAILKCNDKKFNGTGPCTNVSTVQCTHGIRPVVSTQLLLNGSLAEEEVVIRSENFTD
NAKTIIVQLNESVEINCTRPNNNTRKSIHIGPGRAFYTTGEIIGDIRQAHCNISRAKWNNTLKQIVKKLREQFGNKTIVFNQSSGGDPEIVM
HSFNCGGEFFYCNTTQLFNSTWNGTWNNTEGNITLPCRIKQIINMWQEVGKAMYAPPIRGQIRCSSNITGLLLTRDGGNNETEIFRPGGGDM
RDNWRSELYKYKVVKIEPLGVAPTKAKRRVVQREKRAVGIGAMFLGFLGAAGSTMGAASMTLTVQARQLLSGIVQQQNNLLRAIEAQQHLLQ
LTVWGIKQLQARVLAVERYLKDQQLLGIWGCSGKLICTTAVPWNASWSNKSLDEIWDNMTWMEWEREIDNYTSLIYTLIEESQNQQEKNEQE
LLELDKWASLWNWFDITNWLWYIKIFIMIVGGLVGLRIVFAVLSIVNRVRQGYSPLSFQTRLPAPRGPDRPEGIEEEGGERDRDRSGRLVDG
FLALIWDDLRSLCLFSYHRLRDLLLIVTRIVELLGRRGWEVLKYWWNLLQYWSQELKNSAVSLLNATAIAVAEGTDRVIEVVQRACRAILHI
PRRIRQGLERALL$

Fig. 43B

2003 CON_A2 Env.seq.opt

ATGCGCGTGATGGGCACCCAGCGCAACTACCAGCACCTGTGGCGCTGGGGCATCCTGATCCTGGGCATGCTGATCATGTGCAAGGCCACCGA
CCTGTGGGTGACCGTGTACTACGGCGTGCCCGTGTGGAAGGACGCCGACACCACCCTGTTCTGCGCCTCCGACGCCAAGGCCTACGACACCG
AGGTGCACAACGTGTGGGCCACCCACGCCTGCGTGCCCACCGACCCCAACCCCCAGGAGGTGAACCTGGAGAACGTGACCGAGGACTTCAAC
ATGTGGAAGAACAACATGGTGGAGCAGATGCACGAGGACATCATCTCCCTGTGGGACCAGTCCCTGAAGCCCTGCGTGAAGCTGACCCCCCT
GTGCGTGACCCTGAACTGCTCCAACGCCAACACCACCAACAACTCCACCATGGAGGAGATCAAGAACTGCTCCTACAACATCACCACCGAGC
TGCGCGACAAGACCCAGAAGGTGTACTCCCTGTTCTACAAGCTGGACGTGGTGCAGCTGGACGAGTCCAACAAGTCCGAGTACTACTACCGC
CTGATCAACTGCAACACCTCCGCCATCACCCAGGCCTGCCCCAAGGTGTCCTTCGAGCCCATCCCCATCCACTACTGCGCCCCCGCCGGCTT
CGCCATCCTGAAGTGCAAGGACCCCCGCTTCAACGGCACCGGCTCCTGCAACAACGTGTCCTCCGTGCAGTGCACCCACGGCATCAAGCCCG
TGGCCTCCACCCAGCTGCTGCTGAACGGCTCCCTGGCCGAGGGCAAGGTGATGATCCGCTCCGAGAACATCACCAACAACGCCAAGAACATC
ATCGTGCAGTTCAACAAGCCCGTGCCCATCACCTGCATCCGCCCCAACAACAACACCCGCAAGTCCATCCGCTTCGGCCCCGGCCAGGCCTT
CTACACCAACGACATCATCGGCGACATCCGCCAGGCCCACTGCAACATCAACAAGACCAAGTGGAACGCCACCCTGCAGAAGGTGGCCGAGC
AGCTGCGCGAGCACTTCCCCAACAAGACCATCATCTTCACCAACTCCTCCGGCGGCGACCTGGAGATCACCACCCACTCCTTCAACTGCGGC
GGCGAGTTCTTCTACTGCAACACCACCGGCCTGTTCAACTCCACCTGGAAGAACGGCACCACCAACAACACCGAGCAGATGATCACCCTGCC
CTGCCGCATCAAGCAGATCATCAACATGTGGCAGCGCGTGGGCCGCGCCATGTACGCCCCCCCCATCGCCGGCGTGATCAAGTGCACCTCCA
ACATCACCGGCATCATCCTGACCCGCGACGGCGGCAACAACGAGACCGAGACCTTCCGCCCCGGCGGCGGCGACATGCGCGACAACTGGCGC
TCCGAGCTGTACAAGTACAAGGTGGTGAAGATCGAGCCCCTGGGCGTGGCCCCCACCCGCGCCAAGCGCCGCGTGGTGGAGCGCGAGAAGCG
CGCCGTGGGCATGGGCGCCGTGTTCCTGGGCTTCCTGGGCGCCGCCGGCTCCACCATGGGCGCCGCCTCCATCACCCTGACCGTGCAGGCCC
GCCAGCTGCTGTCCGGCATCGTGCAGCAGCAGTCCAACCTGCTGAAGGCCATCGAGGCCCAGCAGCACCTGCTGAAGCTGACCGTGTGGGGC
ATCAAGCAGCTGCAGGCCCGCGTGCTGGCCCTGGAGCGCTACCTGCAGGACCAGCAGCTGCTGGGCATCTGGGGCTGCTCCGGCAAGCTGAT
CTGCGCCACCACCGTGCCCTGGAACTCCTCCTGGTCCAACAAGACCCAGGAGGAGATCTGGAACAACATGACCTGGCTGCAGTGGGACAAGG
AGATCTCCAACTACACCAACATCATCTACAAGCTGCTGGAGGAGTCCCAGAACCAGCAGGAGAAGAACGAGCAGGACCTGCTGGCCCTGGAC
AAGTGGGCCAACCTGTGGAACTGGTTCAACATCACCAACTGGCTGTGGTACATCCGCATCTTCATCATGATCGTGGGCGGCCTGATCGGCCT
GCGCATCGTGATCGCCATCATCTCCGTGGTGAACCGCGTGCGCCAGGGCTACTCCCCCCTGTCCTTCCAGATCCCCACCCCCAACCCCGAGG
GCCTGGACCGCCCCGGCCGCATCGAGGAGGGCGGCGGCGAGCAGGGCCGCGACCGCTCCATCCGCCTGGTGTCCGGCTTCCTGGCCCTGGCC
TGGGACGACCTGCGCTCCCTGTGCCTGTTCTCCTACCACCGCCTGCGCGACTGCATCCTGATCGCCGCCCGCACCGTGGAGCTGCTGGGCCA
CTCCTCCCTGAAGGGCCTGCGCCTGGGCTGGGAGGGCCTGAAGTACCTGTGGAACCTGCTGCTGTACTGGGGCCGCGAGCTGAAGAACTCCG
CCATCTCCCTGCTGGACACCATCGCCGTGGCCGTGGCCGAGTGGACCGACCGCGTGATCGAGATCGGCCAGCGCGCCTGCCGCGCCATCCTG
AACATCCCCCGCCGCATCCGCCAGGGCTTCGAGCGCGCCCTGCTGTAA

Fig. 44B

2003 CON_B Env.seq.opt

ATGCGCGTGAAGGGCATCCGCAAGAACTACCAGCACCTGTGGCGCTGGGGCACCATGCTGCTGGGCATGCTGATGATCTGCTCCGCCGCCGA
GAAGCTGTGGGTGACCGTGTACTACGGCGTGCCCGTGTGGAAGGAGGCCACCACCACCCTGTTCTGCGCCTCCGACGCCAAGGCCTACGACA
CCGAGGTGCACAACGTGTGGGCCACCCACGCCTGCGTGCCCACCGACCCCAACCCCCAGGAGGTGGTGCTGGAGAACGTGACCGAGAACTTC
AACATGTGGAAGAACAACATGGTGGAGCAGATGCACGAGGACATCATCTCCCTGTGGGACCAGTCCCTGAAGCCCTGCGTGAAGCTGACCCC
CCTGTGCGTGACCCTGAACTGCACCGACCTGATGAACGCCACCAACACCAACACCACCATCATCTACCGCTGGCGCGGCGAGATCAAGAACT
GCTCCTTCAACATCACCACCTCCATCCGCGACAAGGTGCAGAAGGAGTACGCCCTGTTCTACAAGCTGGACGTGGTGCCCATCGACAACGAC
AACACCTCCTACCGCCTGATCTCCTGCAACACCTCCGTGATCACCCAGGCCTGCCCCAAGGTGTCCTTCGAGCCCATCCCCATCCACTACTG
CGCCCCCGCCGGCTTCGCCATCCTGAAGTGCAACGACAAGAAGTTCAACGGCACCGGCCCCTGCACCAACGTGTCCACCGTGCAGTGCACCC
ACGGCATCCGCCCCGTGGTGTCCACCCAGCTGCTGCTGAACGGCTCCCTGGCCGAGGAGGAGGTGGTGATCCGCTCCGAGAACTTCACCGAC
AACGCCAAGACCATCATCGTGCAGCTGAACGAGTCCGTGGAGATCAACTGCACCCGCCCCAACAACAACACCCGCAAGTCCATCCACATCGG
CCCCGGCCGCGCCTTCTACACCACCGGCGAGATCATCGGCGACATCCGCCAGGCCCACTGCAACATCTCCCGCGCCAAGTGGAACAACACCC
TGAAGCAGATCGTGAAGAAGCTGCGCGAGCAGTTCGGCAACAAGACCATCGTGTTCAACCAGTCCTCCGGCGGCGACCCCGAGATCGTGATG
CACTCCTTCAACTGCGGCGGCGAGTTCTTCTACTGCAACACCACCCAGCTGTTCAACTCCACCTGGAACGGCACCTGGAACAACACCGAGGG
CAACATCACCCTGCCCTGCCGCATCAAGCAGATCATCAACATGTGGCAGGAGGTGGGCAAGGCCATGTACGCCCCCCCCATCCGCGGCCAGA
TCCGCTGCTCCTCCAACATCACCGGCCTGCTGCTGACCCGCGACGGCGGCAACAACGAGACCGAGATCTTCCGCCCCGGCGGCGGCGACATG
CGCGACAACTGGCGCTCCGAGCTGTACAAGTACAAGGTGGTGAAGATCGAGCCCCTGGGCGTGGCCCCCACCAAGGCCAAGCGCCGCGTGGT
GCAGCGCGAGAAGCGCGCCGTGGGCATCGGCGCCATGTTCCTGGGCTTCCTGGGCGCCGCCGGCTCCACCATGGGCGCCGCCTCCATGACCC
TGACCGTGCAGGCCCGCCAGCTGCTGTCCGGCATCGTGCAGCAGCAGAACAACCTGCTGCGCGCCATCGAGGCCCAGCAGCACCTGCTGCAG
CTGACCGTGTGGGGCATCAAGCAGCTGCAGGCCCGCGTGCTGGCCGTGGAGCGCTACCTGAAGGACCAGCAGCTGCTGGGCATCTGGGGCTG
CTCCGGCAAGCTGATCTGCACCACCGCCGTGCCCTGGAACGCCTCCTGGTCCAACAAGTCCCTGGACGAGATCTGGGACAACATGACCTGGA
TGGAGTGGGAGCGCGAGATCGACAACTACACCTCCCTGATCTACACCCTGATCGAGGAGTCCCAGAACCAGCAGGAGAAGAACGAGCAGGAG
CTGCTGGAGCTGGACAAGTGGGCCTCCCTGTGGAACTGGTTCGACATCACCAACTGGCTGTGGTACATCAAGATCTTCATCATGATCGTGGG
CGGCCTGGTGGGCCTGCGCATCGTGTTCGCCGTGCTGTCCATCGTGAACCGCGTGCGCCAGGGCTACTCCCCCCTGTCCTTCCAGACCCGCC
TGCCCGCCCCCCGCGGCCCCGACCGCCCCGAGGGCATCGAGGAGGAGGGCGGCGAGCGCGACCGCGACCGCTCCGGCCGCCTGGTGGACGGC
TTCCTGGCCCTGATCTGGGACGACCTGCGCTCCCTGTGCCTGTTCTCCTACCACCGCCTGCGCGACCTGCTGCTGATCGTGACCCGCATCGT
GGAGCTGCTGGGCCGCCGCGGCTGGGAGGTGCTGAAGTACTGGTGGAACCTGCTGCAGTACTGGTCCCAGGAGCTGAAGAACTCCGCCGTGT
CCCTGCTGAACGCCACCGCCATCGCCGTGGCCGAGGGCACCGACCGCGTGATCGAGGTGGTGCAGCGCGCCTGCCGCGCCATCCTGCACATC
CCCCGCCGCATCCGCCAGGGCCTGGAGCGCGCCCTGCTGTAA

Fig. 45A

2003 B.anc Env

MRVKGIRKNCQHLWRWGTMLLGMLMICSAAENLWVTVYYGVPVWKEATTTLFCASDAKAYETEVHNVWATHACVPTDPNPQEVVLENVTENF
NMWKNNMVEQMHEDIISLWDQSLKPCVKLTPLCVTLNCTDLLNATNTNSTNMYRWRGEIKNCSFNITTSIRDKMQKEYALFYKLDVVPIDNN
TSYRLINCNTSVITQACPKVSFEPIPIHYCTPAGFAILKCNDKKFNGTGPCKNVSTVQCTHGIRPVVSTQLLLNGSLAEEEVVIRSENFTDN
AKTIIVQLNESVEINCTRPNNNTRKSIHIGPGRAFYATGEIIGDIRQAHCNLSRAKWNNTLKQVVTKLREQFDNKTIVFNPSSGGDPEIVMH
SFNCGGEFFYCNTTQLFNSTWNGTWNNTEGNITLPCRIKQIINMWQEVGKAMYAPPIRGQIRCSSNITGLLLTRDGGNNETEIFRPGGGDMR
DNWRSELYKYKVVKIEPLGVAPTKAKRRVVQREKRAVGIGAMFLGFLGAAGSTMGAASMTLTVQARQLLSGIVQQQNNLLRAIEAQQHLLQL
TVWGIKQLQARVLAVERYLRDQQLLGIWGCSGKLICTTTVPWNASWSNKSLDEIWNNMTWMEWEREIDNYTGLIYTLIEESQNQQEKNEQEL
LELDKWASLWNWFDITNWLWYIKIFIMIVGGLVGLRIVFAVLSIVNRVRQGYSPLSFQTRLPAPRGPDRPEGIEEEGGERDRDRSGRLVNGF
LALIWDDLRSLCLFSYHRLRDLLLIVARIVELLGRRGWEALKYWWNLLQYWSQELKNSAVSLLNATAIAVAEGTDRVIEVVQRACRAILHIP
RRIRQGLERALL$

Fig. 46A

2003 CON_C Env

MRVRGILRNCQQWWIWGILGFWMLMICNVVGNLWVTVYYGVPVWKEAKTTLFCASDAKAYEKEVHNVWATHACVPTDPNPQEIVLENVTENF
NMWKNDMVDQMHEDIISLWDQSLKPCVKLTPLCVTLNCTNATNATNTMGEIKNCSFNITTELRDKKQKVYALFYRLDIVPLNENNSYRLINC
NTSAITQACPKVSFDPIPIHYCAPAGYAILKCNNKTFNGTGPCNNVSTVQCTHGIKPVVSTQLLLNGSLAEEEIIIRSENLTNNAKTIIVHL
NESVEIVCTRPNNNTRKSIRIGPGQTFYATGDIIGDIRQAHCNISEDKWNKTLQKVSKKLKEHFPNKTIKFEPSSGGDLEITTHSFNCRGEF
FYCNTSKLFNSTYNSTNSTITLPCRIKQIINMWQEVGRAMYAPPIAGNITCKSNITGLLLTRDGGKNNTETFRPGGGDMRDNWRSELYKYKV
VEIKPLGIAPTKAKRRVVEREKRAVGIGAVFLGFLGAAGSTMGAASITLTVQARQLLSGIVQQQSNLLRAIEAQQHMLQLTVWGIKQLQTRV
LAIERYLKDQQLLGIWGCSGKLICTTAVPWNSSWSNKSQEDIWDNMTWMQWDREISNYTDTIYRLLEDSQNQQEKNEKDLLALDSWKNLWNW
FDITNWLWYIKIFIMIVGGLIGLRIIFAVLSIVNRVRQGYSPLSFQTLTPNPRGPDRLGRIEEEGGEQDRDRSIRLVSGFLALAWDDLRSLC
LFSYHRLRDFILIAARAVELLGRSSLRGLQRGWEALKYLGSLVQYWGLELKKSAISLLDTIAIAVAEGTDRIIELIQRICRAIRNIPRRIRQ
GFEAALQ$

Fig. 45B

2003 B.anc Env.seq.opt

ATGCGCGTGAAGGGCATCCGCAAGAACTGCCAGCACCTGTGGCGCTGGGGCACCATGCTGCTGGGCATGCTGATGATCTGCTCCGCCGCCGA
GAACCTGTGGGTGACCGTGTACTACGGCGTGCCCGTGTGGAAGGAGGCCACCACCACCCTGTTCTGCGCCTCCGACGCCAAGGCCTACGAGA
CCGAGGTGCACAACGTGTGGGCCACCCACGCCTGCGTGCCCACCGACCCCAACCCCCAGGAGGTGGTGCTGGAGAACGTGACCGAGAACTTC
AACATGTGGAAGAACAACATGGTGGAGCAGATGCACGAGGACATCATCTCCCTGTGGGACCAGTCCCTGAAGCCCTGCGTGAAGCTGACCCC
CCTGTGCGTGACCCTGAACTGCACCGACCTGCTGAACGCCACCAACACCAACTCCACCAACATGTACCGCTGGCGCGGCGAGATCAAGAACT
GCTCCTTCAACATCACCACCTCCATCCGCGACAAGATGCAGAAGGAGTACGCCCTGTTCTACAAGCTGGACGTGGTGCCCATCGACAACAAC
ACCTCCTACCGCCTGATCAACTGCAACACCTCCGTGATCACCCAGGCCTGCCCCAAGGTGTCCTTCGAGCCCATCCCCATCCACTACTGCAC
CCCCGCCGGCTTCGCCATCCTGAAGTGCAACGACAAGAAGTTCAACGGCACCGGCCCCTGCAAGAACGTGTCCACCGTGCAGTGCACCCACG
GCATCCGCCCCGTGGTGTCCACCCAGCTGCTGCTGAACGGCTCCCTGGCCGAGGAGGAGGTGGTGATCCGCTCCGAGAACTTCACCGACAAC
GCCAAGACCATCATCGTGCAGCTGAACGAGTCCGTGGAGATCAACTGCACCCGCCCCAACAACAACACCCGCAAGTCCATCCACATCGGCCC
CGGCCGCGCCTTCTACGCCACCGGCGAGATCATCGGCGACATCCGCCAGGCCCACTGCAACCTGTCCCGCGCCAAGTGGAACAACACCCTGA
AGCAGGTGGTGACCAAGCTGCGCGAGCAGTTCGACAACAAGACCATCGTGTTCAACCCCTCCTCCGGCGGCGACCCCGAGATCGTGATGCAC
TCCTTCAACTGCGGCGGCGAGTTCTTCTACTGCAACACCACCCAGCTGTTCAACTCCACCTGGAACGGCACCTGGAACAACACCGAGGGCAA
CATCACCCTGCCCTGCCGCATCAAGCAGATCATCAACATGTGGCAGGAGGTGGGCAAGGCCATGTACGCCCCCCCCATCCGCGGCCAGATCC
GCTGCTCCTCCAACATCACCGGCCTGCTGCTGACCCGCGACGGCGGCAACAACGAGACCGAGATCTTCCGCCCCGGCGGCGGCGACATGCGC
GACAACTGGCGCTCCGAGCTGTACAAGTACAAGGTGGTGAAGATCGAGCCCCTGGGCGTGGCCCCCACCAAGGCCAAGCGCCGCGTGGTGCA
GCGCGAGAAGCGCGCCGTGGGCATCGGCGCCATGTTCCTGGGCTTCCTGGGCGCCGCCGGCTCCACCATGGGCGCCGCCTCCATGACCCTGA
CCGTGCAGGCCCGCCAGCTGCTGTCCGGCATCGTGCAGCAGCAGAACAACCTGCTGCGCGCCATCGAGGCCCAGCAGCACCTGCTGCAGCTG
ACCGTGTGGGGCATCAAGCAGCTGCAGGCCCGCGTGCTGGCCGTGGAGCGCTACCTGCGCGACCAGCAGCTGCTGGGCATCTGGGGCTGCTC
CGGCAAGCTGATCTGCACCACCACCGTGCCCTGGAACGCCTCCTGGTCCAACAAGTCCCTGGACGAGATCTGGAACAACATGACCTGGATGG
AGTGGGAGCGCGAGATCGACAACTACACCGGCCTGATCTACACCCTGATCGAGGAGTCCCAGAACCAGCAGGAGAAGAACGAGCAGGAGCTG
CTGGAGCTGGACAAGTGGGCCTCCCTGTGGAACTGGTTCGACATCACCAACTGGCTGTGGTACATCAAGATCTTCATCATGATCGTGGGCGG
CCTGGTGGGCCTGCGCATCGTGTTCGCCGTGCTGTCCATCGTGAACCGCGTGCGCCAGGGCTACTCCCCCCTGTCCTTCCAGACCCGCCTGC
CCGCCCCCCGCGGCCCCGACCGCCCCGAGGGCATCGAGGAGGAGGGCGGCGAGCGCGACCGCGACCGCTCCGGCCGCCTGGTGAACGGCTTC
CTGGCCCTGATCTGGGACGACCTGCGCTCCCTGTGCCTGTTCTCCTACCACCGCCTGCGCGACCTGCTGCTGATCGTGGCCCGCATCGTGGA
GCTGCTGGGCCGCCGCGGCTGGGAGGCCCTGAAGTACTGGTGGAACCTGCTGCAGTACTGGTCCCAGGAGCTGAAGAACTCCGCCGTGTCCC
TGCTGAACGCCACCGCCATCGCCGTGGCCGAGGGCACCGACCGCGTGATCGAGGTGGTGCAGCGCGCCTGCCGCGCCATCCTGCACATCCCC
CGCCGCATCCGCCAGGGCCTGGAGCGCGCCCTGCTGTAA

Fig. 46B

2003 CON_C Env.seq.opt

ATGCGCGTGCGCGGCATCCTGCGCAACTGCCAGCAGTGGTGGATCTGGGGCATCCTGGGCTTCTGGATGCTGATGATCTGCAACGTGGTGGG
CAACCTGTGGGTGACCGTGTACTACGGCGTGCCCGTGTGGAAGGAGGCCAAGACCACCCTGTTCTGCGCCTCCGACGCCAAGGCCTACGAGA
AGGAGGTGCACAACGTGTGGGCCACCCACGCCTGCGTGCCCACCGACCCCAACCCCCAGGAGATCGTGCTGGAGAACGTGACCGAGAACTTC
AACATGTGGAAGAACGACATGGTGGACCAGATGCACGAGGACATCATCTCCCTGTGGGACCAGTCCCTGAAGCCCTGCGTGAAGCTGACCCC
CCTGTGCGTGACCCTGAACTGCACCAACGCCACCAACGCCACCAACACCATGGGCGAGATCAAGAACTGCTCCTTCAACATCACCACCGAGC
TGCGCGACAAGAAGCAGAAGGTGTACGCCCTGTTCTACCGCCTGGACATCGTGCCCCTGAACGAGAACAACTCCTACCGCCTGATCAACTGC
AACACCTCCGCCATCACCCAGGCCTGCCCCAAGGTGTCCTTCGACCCCATCCCCATCCACTACTGCGCCCCCGCCGGCTACGCCATCCTGAA
GTGCAACAACAAGACCTTCAACGGCACCGGCCCCTGCAACAACGTGTCCACCGTGCAGTGCACCCACGGCATCAAGCCCGTGGTGTCCACCC
AGCTGCTGCTGAACGGCTCCCTGGCCGAGGAGGAGATCATCATCCGCTCCGAGAACCTGACCAACAACGCCAAGACCATCATCGTGCACCTG
AACGAGTCCGTGGAGATCGTGTGCACCCGCCCCAACAACAACACCCGCAAGTCCATCCGCATCGGCCCCGGCCAGACCTTCTACGCCACCGG
CGACATCATCGGCGACATCCGCCAGGCCCACTGCAACATCTCCGAGGACAAGTGGAACAAGACCCTGCAGAAGGTGTCCAAGAAGCTGAAGG
AGCACTTCCCCAACAAGACCATCAAGTTCGAGCCCTCCTCCGGCGGCGACCTGGAGATCACCACCCACTCCTTCAACTGCCGCGGCGAGTTC
TTCTACTGCAACACCTCCAAGCTGTTCAACTCCACCTACAACTCCACCAACTCCACCATCACCCTGCCCTGCCGCATCAAGCAGATCATCAA
CATGTGGCAGGAGGTGGGCCGCGCCATGTACGCCCCCCCCATCGCCGGCAACATCACCTGCAAGTCCAACATCACCGGCCTGCTGCTGACCC
GCGACGGCGGCAAGAACAACACCGAGACCTTCCGCCCCGGCGGCGGCGACATGCGCGACAACTGGCGCTCCGAGCTGTACAAGTACAAGGTG
GTGGAGATCAAGCCCCTGGGCATCGCCCCCACCAAGGCCAAGCGCCGCGTGGTGGAGCGCGAGAAGCGCGCCGTGGGCATCGGCGCCGTGTT
CCTGGGCTTCCTGGGCGCCGCCGGCTCCACCATGGGCGCCGCCTCCATCACCCTGACCGTGCAGGCCCGCCAGCTGCTGTCCGGCATCGTGC
AGCAGCAGTCCAACCTGCTGCGCGCCATCGAGGCCCAGCAGCACATGCTGCAGCTGACCGTGTGGGGCATCAAGCAGCTGCAGACCCGCGTG
CTGGCCATCGAGCGCTACCTGAAGGACCAGCAGCTGCTGGGCATCTGGGGCTGCTCCGGCAAGCTGATCTGCACCACCGCCGTGCCCTGGAA
CTCCTCCTGGTCCAACAAGTCCCAGGAGGACATCTGGGACAACATGACCTGGATGCAGTGGGACCGCGAGATCTCCAACTACACCGACACCA
TCTACCGCCTGCTGGAGGACTCCCAGAACCAGCAGGAGAAGAACGAGAAGGACCTGCTGGCCCTGGACTCCTGGAAGAACCTGTGGAACTGG
TTCGACATCACCAACTGGCTGTGGTACATCAAGATCTTCATCATGATCGTGGGCGGCCTGATCGGCCTGCGCATCATCTTCGCCGTGCTGTC
CATCGTGAACCGCGTGCGCCAGGGCTACTCCCCCCTGTCCTTCCAGACCCTGACCCCCAACCCCCGCGGCCCCGACCGCCTGGGCCGCATCG
AGGAGGAGGGCGGCGAGCAGGACCGCGACCGCTCCATCCGCCTGGTGTCCGGCTTCCTGGCCCTGGCCTGGGACGACCTGCGCTCCCTGTGC
CTGTTCTCCTACCACCGCCTGCGCGACTTCATCCTGATCGCCGCCCGCGCCGTGGAGCTGCTGGGCCGCTCCTCCCTGCGCGGCCTGCAGCG
CGGCTGGGAGGCCCTGAAGTACCTGGGCTCCCTGGTGCAGTACTGGGGCCTGGAGCTGAAGAAGTCCGCCATCTCCCTGCTGGACACCATCG
CCATCGCCGTGGCCGAGGGCACCGACCGCATCATCGAGCTGATCCAGCGCATCTGCCGCGCCATCCGCAACATCCCCCGCCGCATCCGCCAG
GGCTTCGAGGCCGCCCTGCAGTAA

Fig. 47A

2003 C.anc Env

MRVMGILRNCQQWWIWGILGFWMLMICNVVGNLWVTVYYGVPVWKEAKTTLFCASDAKAYEREVHNVWATHACVPTDPNPQEMVLENVTENF
NMWKNDMVDQMHEDIISLWDQSLKPCVKLTPLCVTLNCTNATNATNTMGEMKNCSFNITTELRDKKQKVYALFYRLDIVPLNDNNSYRLINC
NTSAITQACPKVSFDPIPIHYCAPAGYAILKCNNKTFNGTGPCNNVSTVQCTHGIKPVVSTQLLLNGSLAEEEIIIRSENLTDNAKTIIVHL
NESVEIVCTRPNNNTRKSIRIGPGQTFYATGDIIGDIRQAHCNISEEKWNKTLQRVGEKLKEHFPNKTIKFAPSSGGDLEITTHSFNCRGEF
FYCNTSRLFNSTYNSKNSTITLPCRIKQIINMWQGVGRAMYAPPIAGNITCKSNITGLLLTRDGGKNNTETFRPGGGDMRDNWRSELYKYKV
VEIKPLGIAPTEAKRRVVEREKRAVGIGAVFLGFLGAAGSTMGAASITLTVQARQLLSGIVQQQSNLLRAIEAQQHMLQLTVWGIKQLQTRV
LAIERYLKDQQLLGIWGCSGKLICTTAVPWNSSWSNKSQEEIWDNMTWMQWDREISNYTDTIYRLLEDSQNQQEKNEQDLLALDSWENLWNW
FDITNWLWYIKIFIMIVGGLIGLRIIFAVLSIVNRVRQGYSPLSFQTLTPNPRGPDRLGRIEEEGGEQDRDRSIRLVSGFLALAWDDLRSLC
LFSYHRLRDFILIAARAVELLGRSSLRGLQRGWEALKYLGSLVQYWGLELKKSAISLLDTIAIAVAEGTDRIIELIQRICRAIRNIPRRIRQ
GFEAALL$

Fig. 48A

2003 CON_D Env

MRVRGIQRNYQHLWRWGIMLLGMLMICSVAENLWVTVYYGVPVWKEATTTLFCASDAKSYKTEAHNIWATHACVPTDPNPQEIELENVTENF
NMWKNNMVEQMHEDIISLWDQSLKPCVKLTPLCVTLNCTDVKRNNTSNDTNEGEMKNCSFNITTEIRDKKKQVHALFYKLDVVPIDDNNSNT
SYRLINCNTSAITQACPKVTFEPIPIHYCAPAGFAILKCKDKKFNGTGPCKNVSTVQCTHGIRPVVSTQLLLNGSLAEEEIIIRSENLTNNA
KIIIVQLNESVTINCTRPYNNTRQRTPIGPGQALYTTRIKGDIRQAHCNISRAEWNKTLQQVAKKLGDLLNKTTIIFKPSSGGDPEITTHSF
NCGGEFFYCNTSRLFNSTWNNTKWNSTGKITLPCRIKQIINMWQGVGKAMYAPPIEGLIKCSSNITGLLLTRDGGANNSHNETFRPGGGDMR
DNWRSELYKYKVVKIEPLGVAPTRAKRRVVEREKRAIGLGAMFLGFLGAAGSTMGAASMTLTVQARQLLSGIVQQQNNLLRAIEAQQHLLQL
TVWGIKQLQARILAVERYLKDQQLLGIWGCSGKHICTTTVPWNSSWSNKSLDEIWNNMTWMEWEREIDNYTGLIYSLIEESQNQQEKNEQEL
LELDKWASLWNWFSITQWLWYIKIFIMIVGGLIGLRIVFAVLSLVNRVRQGYSPLSFQTLLPAPRGPDRPEGIEEEGGEQGRGRSIRLVNGF
SALIWDDLRNLCLFSYHRLRDLILIAARIVELLGRRGWEALKYLWNLLQYWIQELKNSAISLFDTTAIAVAEGTDRVIEIVQRACRAILNIP
TRIRQGLERALL$

Fig. 47B

2003 C.anc Env.seq.opt

ATGCGCGTGATGGGCATCCTGCGCAACTGCCAGCAGTGGTGGATCTGGGGCATCCTGGGCTTCTGGATGCTGATGATCTGCAACGTGGTGGG
CAACCTGTGGGTGACCGTGTACTACGGCGTGCCCGTGTGGAAGGAGGCCAAGACCACCCTGTTCTGCGCCTCCGACGCCAAGGCCTACGAGC
GCGAGGTGCACAACGTGTGGGCCACCCACGCCTGCGTGCCCACCGACCCCAACCCCCAGGAGATGGTGCTGGAGAACGTGACCGAGAACTTC
AACATGTGGAAGAACGACATGGTGGACCAGATGCACGAGGACATCATCTCCCTGTGGGACCAGTCCCTGAAGCCCTGCGTGAAGCTGACCCC
CCTGTGCGTGACCCTGAACTGCACCAACGCCACCAACGCCACCAACACCATGGGCGAGATGAAGAACTGCTCCTTCAACATCACCACCGAGC
TGCGCGACAAGAAGCAGAAGGTGTACGCCCTGTTCTACCGCCTGGACATCGTGCCCCTGAACGACAACAACTCCTACCGCCTGATCAACTGC
AACACCTCCGCCATCACCCAGGCCTGCCCCAAGGTGTCCTTCGACCCCATCCCCATCCACTACTGCGCCCCCGCCGGCTACGCCATCCTGAA
GTGCAACAACAAGACCTTCAACGGCACCGGCCCCTGCAACAACGTGTCCACCGTGCAGTGCACCCACGGCATCAAGCCCGTGGTGTCCACCC
AGCTGCTGCTGAACGGCTCCCTGGCCGAGGAGGAGATCATCATCCGCTCCGAGAACCTGACCGACAACGCCAAGACCATCATCGTGCACCTG
AACGAGTCCGTGGAGATCGTGTGCACCCGCCCCAACAACAACACCCGCAAGTCCATCCGCATCGGCCCCGGCCAGACCTTCTACGCCACCGG
CGACATCATCGGCGACATCCGCCAGGCCCACTGCAACATCTCCGAGGAGAAGTGGAACAAGACCCTGCAGCGCGTGGGCGAGAAGCTGAAGG
AGCACTTCCCCAACAAGACCATCAAGTTCGCCCCCTCCTCCGGCGGCGACCTGGAGATCACCACCCACTCCTTCAACTGCCGCGGCGAGTTC
TTCTACTGCAACACCTCCCGCCTGTTCAACTCCACCTACAACTCCAAGAACTCCACCATCACCCTGCCCTGCCGCATCAAGCAGATCATCAA
CATGTGGCAGGGCGTGGGCCGCGCCATGTACGCCCCCCCCATCGCCGGCAACATCACCTGCAAGTCCAACATCACCGGCCTGCTGCTGACCC
GCGACGGCGGCAAGAACAACACCGAGACCTTCCGCCCCGGCGGCGGCGACATGCGCGACAACTGGCGCTCCGAGCTGTACAAGTACAAGGTG
GTGGAGATCAAGCCCCTGGGCATCGCCCCCACCGAGGCCAAGCGCCGCGTGGTGGAGCGCGAGAAGCGCGCCGTGGGCATCGGCGCCGTGTT
CCTGGGCTTCCTGGGCGCCGCCGGCTCCACCATGGGCGCCGCCTCCATCACCCTGACCGTGCAGGCCCGCCAGCTGCTGTCCGGCATCGTGC
AGCAGCAGTCCAACCTGCTGCGCGCCATCGAGGCCCAGCAGCACATGCTGCAGCTGACCGTGTGGGGCATCAAGCAGCTGCAGACCCGCGTG
CTGGCCATCGAGCGCTACCTGAAGGACCAGCAGCTGCTGGGCATCTGGGGCTGCTCCGGCAAGCTGATCTGCACCACCGCCGTGCCCTGGAA
CTCCTCCTGGTCCAACAAGTCCCAGGAGGAGATCTGGGACAACATGACCTGGATGCAGTGGGACCGCGAGATCTCCAACTACACCGACACCA
TCTACCGCCTGCTGGAGGACTCCCAGAACCAGCAGGAGAAGAACGAGCAGGACCTGCTGGCCCTGGACTCCTGGGAGAACCTGTGGAACTGG
TTCGACATCACCAACTGGCTGTGGTACATCAAGATCTTCATCATGATCGTGGGCGGCCTGATCGGCCTGCGCATCATCTTCGCCGTGCTGTC
CATCGTGAACCGCGTGCGCCAGGGCTACTCCCCCCTGTCCTTCCAGACCCTGACCCCCAACCCCCGCGGCCCCGACCGCCTGGGCCGCATCG
AGGAGGAGGGCGGCGAGCAGGACCGCGACCGCTCCATCCGCCTGGTGTCCGGCTTCCTGGCCCTGGCCTGGGACGACCTGCGCTCCCTGTGC
CTGTTCTCCTACCACCGCCTGCGCGACTTCATCCTGATCGCCGCCCGCGCCGTGGAGCTGCTGGGCCGCTCCTCCCTGCGCGGCCTGCAGCG
CGGCTGGGAGGCCCTGAAGTACCTGGGCTCCCTGGTGCAGTACTGGGGCCTGGAGCTGAAGAAGTCCGCCATCTCCCTGCTGGACACCATCG
CCATCGCCGTGGCCGAGGGCACCGACCGCATCATCGAGCTGATCCAGCGCATCTGCCGCGCCATCCGCAACATCCCCCGCCGCATCCGCCAG
GGCTTCGAGGCCGCCCTGCTGTAA

Fig. 48B

2003 CON_D Env.seq.opt

ATGCGCGTGCGCGGCATCCAGCGCAACTACCAGCACCTGTGGCGCTGGGGCATCATGCTGCTGGGCATGCTGATGATCTGCTCCGTGGCCGA
GAACCTGTGGGTGACCGTGTACTACGGCGTGCCCGTGTGGAAGGAGGCCACCACCACCCTGTTCTGCGCCTCCGACGCCAAGTCCTACAAGA
CCGAGGCCCACAACATCTGGGCCACCCACGCCTGCGTGCCCACCGACCCCAACCCCCAGGAGATCGAGCTGGAGAACGTGACCGAGAACTTC
AACATGTGGAAGAACAACATGGTGGAGCAGATGCACGAGGACATCATCTCCCTGTGGGACCAGTCCCTGAAGCCCTGCGTGAAGCTGACCCC
CCTGTGCGTGACCCTGAACTGCACCGACGTGAAGCGCAACAACACCTCCAACGACACCAACGAGGGCGAGATGAAGAACTGCTCCTTCAACA
TCACCACCGAGATCCGCGACAAGAAGAAGCAGGTGCACGCCCTGTTCTACAAGCTGGACGTGGTGCCCATCGACGACAACAACTCCAACACC
TCCTACCGCCTGATCAACTGCAACACCTCCGCCATCACCCAGGCCTGCCCCAAGGTGACCTTCGAGCCCATCCCCATCCACTACTGCGCCCC
CGCCGGCTTCGCCATCCTGAAGTGCAAGGACAAGAAGTTCAACGGCACCGGCCCCTGCAAGAACGTGTCCACCGTGCAGTGCACCCACGGCA
TCCGCCCCGTGGTGTCCACCCAGCTGCTGCTGAACGGCTCCCTGGCCGAGGAGGAGATCATCATCCGCTCCGAGAACCTGACCAACAACGCC
AAGATCATCATCGTGCAGCTGAACGAGTCCGTGACCATCAACTGCACCCGCCCCTACAACAACACCCGCCAGCGCACCCCCATCGGCCCCGG
CCAGGCCCTGTACACCACCCGCATCAAGGGCGACATCCGCCAGGCCCACTGCAACATCTCCCGCGCCGAGTGGAACAAGACCCTGCAGCAGG
TGGCCAAGAAGCTGGGCGACCTGCTGAACAAGACCACCATCATCTTCAAGCCCTCCTCCGGCGGCGACCCCGAGATCACCACCCACTCCTTC
AACTGCGGCGGCGAGTTCTTCTACTGCAACACCTCCCGCCTGTTCAACTCCACCTGGAACAACACCAAGTGGAACTCCACCGGCAAGATCAC
CCTGCCCTGCCGCATCAAGCAGATCATCAACATGTGGCAGGGCGTGGGCAAGGCCATGTACGCCCCCCCCATCGAGGGCCTGATCAAGTGCT
CCTCCAACATCACCGGCCTGCTGCTGACCCGCGACGGCGGCGCCAACAACTCCCACAACGAGACCTTCCGCCCCGGCGGCGGCGACATGCGC
GACAACTGGCGCTCCGAGCTGTACAAGTACAAGGTGGTGAAGATCGAGCCCCTGGGCGTGGCCCCCACCCGCGCCAAGCGCCGCGTGGTGGA
GCGCGAGAAGCGCGCCATCGGCCTGGGCGCCATGTTCCTGGGCTTCCTGGGCGCCGCCGGCTCCACCATGGGCGCCGCCTCCATGACCCTGA
CCGTGCAGGCCCGCCAGCTGCTGTCCGGCATCGTGCAGCAGCAGAACAACCTGCTGCGCGCCATCGAGGCCCAGCAGCACCTGCTGCAGCTG
ACCGTGTGGGGCATCAAGCAGCTGCAGGCCCGCATCCTGGCCGTGGAGCGCTACCTGAAGGACCAGCAGCTGCTGGGCATCTGGGGCTGCTC
CGGCAAGCACATCTGCACCACCACCGTGCCCTGGAACTCCTCCTGGTCCAACAAGTCCCTGGACGAGATCTGGAACAACATGACCTGGATGG
AGTGGGAGCGCGAGATCGACAACTACACCGGCCTGATCTACTCCCTGATCGAGGAGTCCCAGAACCAGCAGGAGAAGAACGAGCAGGAGCTG
CTGGAGCTGGACAAGTGGGCCTCCCTGTGGAACTGGTTCTCCATCACCCAGTGGCTGTGGTACATCAAGATCTTCATCATGATCGTGGGCGG
CCTGATCGGCCTGCGCATCGTGTTCGCCGTGCTGTCCCTGGTGAACCGCGTGCGCCAGGGCTACTCCCCCCTGTCCTTCCAGACCCTGCTGC
CCGCCCCCCGCGGCCCCGACCGCCCCGAGGGCATCGAGGAGGAGGGCGGCGAGCAGGGCCGCGGCCGCTCCATCCGCCTGGTGAACGGCTTC
TCCGCCCTGATCTGGGACGACCTGCGCAACCTGTGCCTGTTCTCCTACCACCGCCTGCGCGACCTGATCCTGATCGCCGCCCGCATCGTGGA
GCTGCTGGGCCGCCGCGGCTGGGAGGCCCTGAAGTACCTGTGGAACCTGCTGCAGTACTGGATCCAGGAGCTGAAGAACTCCGCCATCTCCC
TGTTCGACACCACCGCCATCGCCGTGGCCGAGGGCACCGACCGCGTGATCGAGATCGTGCAGCGCGCCTGCCGCGCCATCCTGAACATCCCC
ACCCGCATCCGCCAGGGCCTGGAGCGCGCCCTGCTGTAA

Fig. 49A

2003 CON_F1 Env

MRVRGMQRNWQHLGKWGLLFLGILIICNAAENLWVTVYYGVPVWKEATTTLFCASDAKSYEKEVHNVWATHACVPTDPNPQEVVLENVTENF
DMWKNNMVEQMHTDIISLWDQSLKPCVKLTPLCVTLNCTDVNATNNDTNDNKTGAIQNCSFNMTTEVRDKKLKVHALFYKLDIVPISNNNSK
YRLINCNTSTITQACPKVSWDPIPIHYCAPAGYAILKCNDKRFNGTGPCKNVSTVQCTHGIKPVVSTQLLLNGSLAEEDIIIRSQNISDNAK
TIIVHLNESVQINCTRPNNNTRKSIHLGPGQAFYATGEIIGDIRKAHCNISGTQWNKTLEQVKAKLKSHFPNKTIKFNSSSGGDLEITMHSF
NCRGEFFYCNTSGLFNDTGSNGTITLPCRIKQIVNMWQEVGRAMYAAPIAGNITCNSNITGLLLTRDGGQNNTETFRPGGGNMKDNWRSELY
KYKVVEIEPLGVAPTKAKRQVVKRERRAVGIGAVFLGFLGAAGSTMGAASITLTVQARQLLSGIVQQQNNLLRAIEAQQHLLQLTVWGIKQL
QARVLAVERYLKDQQLLGLWGCSGKLICTTNVPWNSSWSNKSQDEIWNNMTWMEWEKEISNYSNIIYRLIEESQNQQEKNEQELLALDKWAS
LWNWFDISNWLWYIKIFIMIVGGLIGLRIVFAVLSIVNRVRKGYSPLSLQTLIPSPREPDRPEGIEEGGGEQGKDRSVRLVNGFLALVWDDL
RNLCLFSYRHLRDFILIAARIVDRGLRRGWEALKYLGNLTQYWSQELKNSAISLLNTTAIVVAEGTDRVIEALQRAGRAVLNIPRRIRQGLE
RALL$

Fig. 50A

2003 CON_F2 Env

MRVREMQRNWQHLGKWGLLFLGILIICNAADNLWVTVYYGVPVWKEATTTLFCASDAKAYEREVHNVWATYACVPTDPSPQELVLGNVTENF
NMWKNNMVDQMHEDIISLWDQSLKPCVKLTPLCVTLNCTDVNVTINTTNVTLGEIKNCSFNITTEIKDKKKKEYALFYRLDVVPINNSIVYR
LISCNTSTVTQACPKVSFEPIPIHYCAPAGFAILKCNDKKFNGTGLCRNVSTVQCTHGIRPVVSTQLLLNGSLAEEDIIIRSENISDNTKTI
IVQFNRSVEINCTRPNNNTRKSIRIGPGRAFYATGDIIGDIRKAYCNINRTLWNETLKKVAEEFKNHFNITVTFNPSSGGDLEITTHSFNCR
GEFFYCNTSDLFNNTEVNNTKTITLPCRIRQFVNMWQRVGRAMYAPPIAGQIQCNSNITGLLLTRDGGKNGSETLRPGGGDMRDNWRSELYK
YKVVKIEPLGVAPTKAKRQVVQREKRAVGIGAVLLGFLGAAGSTMGAASITLTVQARQLLSGIVQQQSNLLKAIEAQQHLLQLTVWGIKQLQ
ARILAVERYLKDQQLLGIWGCSGKLICTTNVPWNSSWSNKSQDEIWDNMTWMQWEKEISNYTDTIYRLIEDAQNQQEKNEQDLLALDKWDNL
WSWFTITNWLWYIKIFIMIVGGLIGLRIVFAVLSVVNRVRQGYSPLSLQTLIPNPRGPERPGGIEEEGGEQDRDRSIRLVSGFLALAWDDLR
SLCLFSYRHLRDFILIAARTVDMGLKRGWEALKYLWNLPQYWGQELKNSAISLLDTTAIAVAEGTDRIIEVLQRAGRAVLHIPRRIRQGFER
ALL$

Fig. 49B

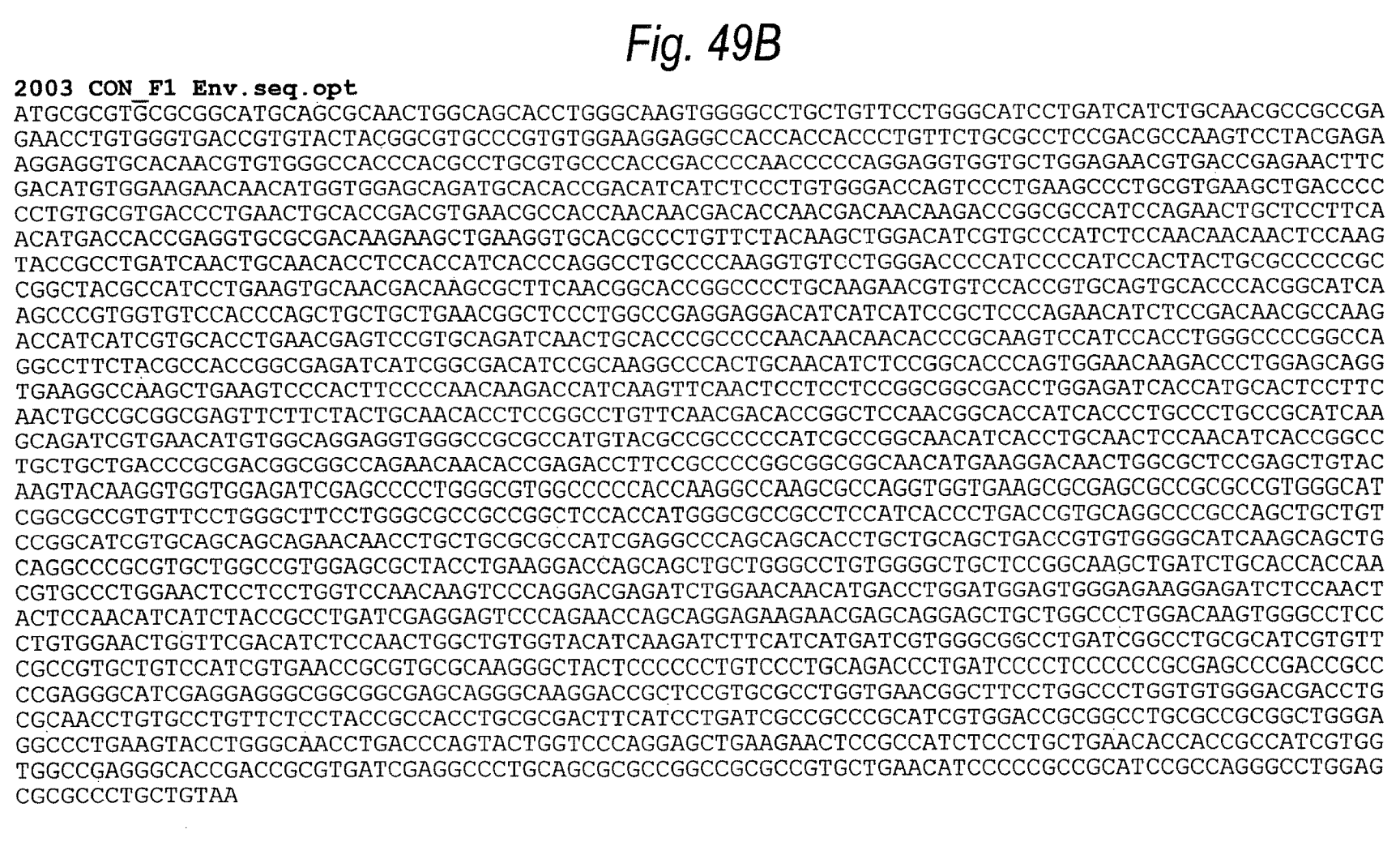

2003 CON_F1 Env.seq.opt

ATGCGCGTGCGCGGCATGCAGCGCAACTGGCAGCACCTGGGCAAGTGGGGCCTGCTGTTCCTGGGCATCCTGATCATCTGCAACGCCGCCGA
GAACCTGTGGGTGACCGTGTACTACGGCGTGCCCGTGTGGAAGGAGGCCACCACCACCCTGTTCTGCGCCTCCGACGCCAAGTCCTACGAGA
AGGAGGTGCACAACGTGTGGGCCACCCACGCCTGCGTGCCCACCGACCCCAACCCCCAGGAGGTGGTGCTGGAGAACGTGACCGAGAACTTC
GACATGTGGAAGAACAACATGGTGGAGCAGATGCACACCGACATCATCTCCCTGTGGGACCAGTCCCTGAAGCCCTGCGTGAAGCTGACCCC
CCTGTGCGTGACCCTGAACTGCACCGACGTGAACGCCACCAACAACGACACCAACGACAACAAGACCGGCGCCATCCAGAACTGCTCCTTCA
ACATGACCACCGAGGTGCGCGACAAGAAGCTGAAGGTGCACGCCCTGTTCTACAAGCTGGACATCGTGCCCATCTCCAACAACAACTCCAAG
TACCGCCTGATCAACTGCAACACCTCCACCATCACCCAGGCCTGCCCCAAGGTGTCCTGGGACCCCATCCCCATCCACTACTGCGCCCCCGC
CGGCTACGCCATCCTGAAGTGCAACGACAAGCGCTTCAACGGCACCGGCCCCTGCAAGAACGTGTCCACCGTGCAGTGCACCCACGGCATCA
AGCCCGTGGTGTCCACCCAGCTGCTGCTGAACGGCTCCCTGGCCGAGGAGGACATCATCATCCGCTCCCAGAACATCTCCGACAACGCCAAG
ACCATCATCGTGCACCTGAACGAGTCCGTGCAGATCAACTGCACCCGCCCCAACAACAACACCCGCAAGTCCATCCACCTGGGCCCCGGCCA
GGCCTTCTACGCCACCGGCGAGATCATCGGCGACATCCGCAAGGCCCACTGCAACATCTCCGGCACCCAGTGGAACAAGACCCTGGAGCAGG
TGAAGGCCAAGCTGAAGTCCCACTTCCCCAACAAGACCATCAAGTTCAACTCCTCCTCCGGCGGCGACCTGGAGATCACCATGCACTCCTTC
AACTGCCGCGGCGAGTTCTTCTACTGCAACACCTCCGGCCTGTTCAACGACACCGGCTCCAACGGCACCATCACCCTGCCCTGCCGCATCAA
GCAGATCGTGAACATGTGGCAGGAGGTGGGCCGCGCCATGTACGCCGCCCCCATCGCCGGCAACATCACCTGCAACTCCAACATCACCGGCC
TGCTGCTGACCCGCGACGGCGGCCAGAACAACACCGAGACCTTCCGCCCCGGCGGCGGCAACATGAAGGACAACTGGCGCTCCGAGCTGTAC
AAGTACAAGGTGGTGGAGATCGAGCCCCTGGGCGTGGCCCCCACCAAGGCCAAGCGCCAGGTGGTGAAGCGCGAGCGCCGCGCCGTGGGCAT
CGGCGCCGTGTTCCTGGGCTTCCTGGGCGCCGCCGGCTCCACCATGGGCGCCGCCTCCATCACCCTGACCGTGCAGGCCCGCCAGCTGCTGT
CCGGCATCGTGCAGCAGCAGAACAACCTGCTGCGCGCCATCGAGGCCCAGCAGCACCTGCTGCAGCTGACCGTGTGGGGCATCAAGCAGCTG
CAGGCCCGCGTGCTGGCCGTGGAGCGCTACCTGAAGGACCAGCAGCTGCTGGGCCTGTGGGGCTGCTCCGGCAAGCTGATCTGCACCACCAA
CGTGCCCTGGAACTCCTCCTGGTCCAACAAGTCCCAGGACGAGATCTGGAACAACATGACCTGGATGGAGTGGGAGAAGGAGATCTCCAACT
ACTCCAACATCATCTACCGCCTGATCGAGGAGTCCCAGAACCAGCAGGAGAAGAACGAGCAGGAGCTGCTGGCCCTGGACAAGTGGGCCTCC
CTGTGGAACTGGTTCGACATCTCCAACTGGCTGTGGTACATCAAGATCTTCATCATGATCGTGGGCGGCCTGATCGGCCTGCGCATCGTGTT
CGCCGTGCTGTCCATCGTGAACCGCGTGCGCAAGGGCTACTCCCCCCTGTCCCTGCAGACCCTGATCCCCTCCCCCCGCGAGCCCGACCGCC
CCGAGGGCATCGAGGAGGGCGGCGGCGAGCAGGGCAAGGACCGCTCCGTGCGCCTGGTGAACGGCTTCCTGGCCCTGGTGTGGGACGACCTG
CGCAACCTGTGCCTGTTCTCCTACCGCCACCTGCGCGACTTCATCCTGATCGCCGCCCGCATCGTGGACCGCGGCCTGCGCCGCGGCTGGGA
GGCCCTGAAGTACCTGGGCAACCTGACCCAGTACTGGTCCCAGGAGCTGAAGAACTCCGCCATCTCCCTGCTGAACACCACCGCCATCGTGG
TGGCCGAGGGCACCGACCGCGTGATCGAGGCCCTGCAGCGCGCCGGCCGCGCCGTGCTGAACATCCCCCGCCGCATCCGCCAGGGCCTGGAG
CGCGCCCTGCTGTAA

Fig. 50B

2003 CON_F2 Env.seq.opt

ATGCGCGTGCGCGAGATGCAGCGCAACTGGCAGCACCTGGGCAAGTGGGGCCTGCTGTTCCTGGGCATCCTGATCATCTGCAACGCCGCCGA
CAACCTGTGGGTGACCGTGTACTACGGCGTGCCCGTGTGGAAGGAGGCCACCACCACCCTGTTCTGCGCCTCCGACGCCAAGGCCTACGAGC
GCGAGGTGCACAACGTGTGGGCCACCTACGCCTGCGTGCCCACCGACCCCTCCCCCCAGGAGCTGGTGCTGGGCAACGTGACCGAGAACTTC
AACATGTGGAAGAACAACATGGTGGACCAGATGCACGAGGACATCATCTCCCTGTGGGACCAGTCCCTGAAGCCCTGCGTGAAGCTGACCCC
CCTGTGCGTGACCCTGAACTGCACCGACGTGAACGTGACCATCAACACCACCAACGTGACCCTGGGCGAGATCAAGAACTGCTCCTTCAACA
TCACCACCGAGATCAAGGACAAGAAGAAGAAGGAGTACGCCCTGTTCTACCGCCTGGACGTGGTGCCCATCAACAACTCCATCGTGTACCGC
CTGATCTCCTGCAACACCTCCACCGTGACCCAGGCCTGCCCCAAGGTGTCCTTCGAGCCCATCCCCATCCACTACTGCGCCCCCGCCGGCTT
CGCCATCCTGAAGTGCAACGACAAGAAGTTCAACGGCACCGGCCTGTGCCGCAACGTGTCCACCGTGCAGTGCACCCACGGCATCCGCCCCG
TGGTGTCCACCCAGCTGCTGCTGAACGGCTCCCTGGCCGAGGAGGACATCATCATCCGCTCCGAGAACATCTCCGACAACACCAAGACCATC
ATCGTGCAGTTCAACCGCTCCGTGGAGATCAACTGCACCCGCCCCAACAACAACACCCGCAAGTCCATCCGCATCGGCCCCGGCCGCGCCTT
CTACGCCACCGGCGACATCATCGGCGACATCCGCAAGGCCTACTGCAACATCAACCGCACCCTGTGGAACGAGACCCTGAAGAAGGTGGCCG
AGGAGTTCAAGAACCACTTCAACATCACCGTGACCTTCAACCCCTCCTCCGGCGGCGACCTGGAGATCACCACCCACTCCTTCAACTGCCGC
GGCGAGTTCTTCTACTGCAACACCTCCGACCTGTTCAACAACACCGAGGTGAACAACACCAAGACCATCACCCTGCCCTGCCGCATCCGCCA
GTTCGTGAACATGTGGCAGCGCGTGGGCCGCGCCATGTACGCCCCCCCCATCGCCGGCCAGATCCAGTGCAACTCCAACATCACCGGCCTGC
TGCTGACCCGCGACGGCGGCAAGAACGGCTCCGAGACCCTGCGCCCCGGCGGCGGCGACATGCGCGACAACTGGCGCTCCGAGCTGTACAAG
TACAAGGTGGTGAAGATCGAGCCCCTGGGCGTGGCCCCCACCAAGGCCAAGCGCCAGGTGGTGCAGCGCGAGAAGCGCGCCGTGGGCATCGG
CGCCGTGCTGCTGGGCTTCCTGGGCGCCGCCGGCTCCACCATGGGCGCCGCCTCCATCACCCTGACCGTGCAGGCCCGCCAGCTGCTGTCCG
GCATCGTGCAGCAGCAGTCCAACCTGCTGAAGGCCATCGAGGCCCAGCAGCACCTGCTGCAGCTGACCGTGTGGGGCATCAAGCAGCTGCAG
GCCCGCATCCTGGCCGTGGAGCGCTACCTGAAGGACCAGCAGCTGCTGGGCATCTGGGGCTGCTCCGGCAAGCTGATCTGCACCACCAACGT
GCCCTGGAACTCCTCCTGGTCCAACAAGTCCCAGGACGAGATCTGGGACAACATGACCTGGATGCAGTGGGAGAAGGAGATCTCCAACTACA
CCGACACCATCTACCGCCTGATCGAGGACGCCCAGAACCAGCAGGAGAAGAACGAGCAGGACCTGCTGGCCCTGGACAAGTGGGACAACCTG
TGGTCCTGGTTCACCATCACCAACTGGCTGTGGTACATCAAGATCTTCATCATGATCGTGGGCGGCCTGATCGGCCTGCGCATCGTGTTCGC
CGTGCTGTCCGTGGTGAACCGCGTGCGCCAGGGCTACTCCCCCCTGTCCCTGCAGACCCTGATCCCCAACCCCCGCGGCCCCGAGCGCCCCG
GCGGCATCGAGGAGGAGGGCGGCGAGCAGGACCGCGACCGCTCCATCCGCCTGGTGTCCGGCTTCCTGGCCCTGGCCTGGGACGACCTGCGC
TCCCTGTGCCTGTTCTCCTACCGCCACCTGCGCGACTTCATCCTGATCGCCGCCCGCACCGTGGACATGGGCCTGAAGCGCGGCTGGGAGGC
CCTGAAGTACCTGTGGAACCTGCCCCAGTACTGGGGCCAGGAGCTGAAGAACTCCGCCATCTCCCTGCTGGACACCACCGCCATCGCCGTGG
CCGAGGGCACCGACCGCATCATCGAGGTGCTGCAGCGCGCCGGCCGCGCCGTGCTGCACATCCCCCGCCGCATCCGCCAGGGCTTCGAGCGC
GCCCTGCTGTAA

*Fig. 51A*

2003 CON_G Env

MRVKGIQRNWQHLWKWGTLILGLVIICSASNNLWVTVYYGVPVWEDADTTLFCASDAKAYSTERHNVWATHACVPTDPNPQEITLENVTENF
NMWKNNMVEQMHEDIISLWDESLKPCVKLTPLCVTLNCTDVNVTNNNTNNTKKEIKNCSFNITTEIRDKKKKEYALFYRLDVVPINDNGNSS
IYRLINCNVSTIKQACPKVTFDPIPIHYCAPAGFAILKCRDKKFNGTGPCKNVSTVQCTHGIKPVVSTQLLLNGSLAEEEIIIRSENITDNT
KVIIVQLNETIEINCTRPNNNTRKSIRIGPGQAFYATGDIIGDIRQAHCNVSRTKWNEMLQKVKAQLKKIFNKSITFNSSSGGDLEITTHSF
NCRGEFFYCNTSGLFNNSLLNSTNSTITLPCKIKQIVRMWQRVGQAMYAPPIAGNITCRSNITGLLLTRDGGNNNTETFRPGGGDMRDNWRS
ELYKYKIVKIKPLGVAPTRARRRVVEREKRAVGLGAVLLGFLGAAGSTMGAASITLTVQVRQLLSGIVQQQSNLLRAIEAQQHLLQLTVWGI
KQLQARVLAVERYLKDQQLLGIWGCSGKLICTTNVPWNTSWSNKSYNEIWDNMTWIEWEREISNYTQQIYSLIEESQNQQEKNEQDLLALDK
WASLWNWFDITKWLWYIKIFIMIVGGLIGLRIVFAVLSIVNRVRQGYSPLSFQTLTHHQREPDRPERIEEGGGEQDKDRSIRLVSGFLALAW
DDLRSLCLFSYHRLRDFILIAARTVELLGRSSLKGLRLGWEGLKYLWNLLLYWGQELKNSAINLLDTIAIAVANWTDRVIEVAQRACRAILN
IPRRIRQGLERALL$

*Fig. 52A*

2003 CON_H Env

TRVMETQRNYPSLWRWGTLILGMLLICSAAGNLWVTVYYGVPVWKEAKTTLFCASDAKAYETEKHNVWATHACVPTDPNPQEMVLENVTENF
NMWENDMVEQMHTDIISLWDQSLKPCVKLTPLCVTLDCSNVNTTNATNSRFNMQEELTNCSFNVTTVIRDKQQKVHALFYRLDVVPIDDNNS
YQYRLINCNTSVITQACPKVSFEPIPIHYCAPAGFAILKCNNKTFNGTGPCTNVSTVQCTHGIRPVVSTQLLLNGSLAEEQVIIRSKNISDN
TKNIIVQLNKPVEITCTRPNNNTRKSIHLGPGQAFYATGDIIGDIRQAHCNISGKKWNKTLHQVVTQLGKYFDNRTIIFKPHSGGDMEVTTH
SFNCRGEFFYCNTSGLFNSSWTNSTNDTKNIITLPCRIKQIVNMWQRVGQAMYAPPIKGNITCVSNITGLILTFDEGNNTVTFRPGGGDMRD
NWRSELYKYKVVKIEPLGVAPTEARRRVVEREKRAVGMGAFFLGFLGAAGSTMGAASITLTVQARQLLSGIVQQQSNLLRAIQAQQHMLQLT
VWGIKQLQARVLAVERYLKDQQLLGIWGCSGKLICTTNVPWNSSWSNKSLDEIWDNMTWMEWDKQINNYTEEIYRLLEVSQTQQEKNEQDLL
ALDKWASLWNWFSITNWLWYIKIFIMIVGGLIGLRIIFAVLSIVNRVRQGYSPLSFQTLIPNPRGPDRPEGIEEEGGEQDRDRSVRLVNGFL
PLVWDDLRSLCLFSYRLLRDLLLIVVRTVELLGRRGREALKYLWNLLQYWGQELKNSAINLLNTTAIAVAEGTDRIIEIVQRAWRAILHIPR
RIRQGFERTLL$

Fig. 51B

2003 CON_G Env.seq.opt

ATGCGCGTGAAGGGCATCCAGCGCAACTGGCAGCACCTGTGGAAGTGGGGCACCCTGATCCTGGGCCTGGTGATCATCTGCTCCGCCTCCAA
CAACCTGTGGGTGACCGTGTACTACGGCGTGCCCGTGTGGGAGGACGCCGACACCACCCTGTTCTGCGCCTCCGACGCCAAGGCCTACTCCA
CCGAGCGCCACAACGTGTGGGCCACCCACGCCTGCGTGCCCACCGACCCCAACCCCCAGGAGATCACCCTGGAGAACGTGACCGAGAACTTC
AACATGTGGAAGAACAACATGGTGGAGCAGATGCACGAGGACATCATCTCCCTGTGGGACGAGTCCCTGAAGCCCTGCGTGAAGCTGACCCC
CCTGTGCGTGACCCTGAACTGCACCGACGTGAACGTGACCAACAACAACACCAACAACACCAAGAAGGAGATCAAGAACTGCTCCTTCAACA
TCACCACCGAGATCCGCGACAAGAAGAAGAAGGAGTACGCCCTGTTCTACCGCCTGGACGTGGTGCCCATCAACGACAACGGCAACTCCTCC
ATCTACCGCCTGATCAACTGCAACGTGTCCACCATCAAGCAGGCCTGCCCCAAGGTGACCTTCGACCCCATCCCCATCCACTACTGCGCCCC
CGCCGGCTTCGCCATCCTGAAGTGCCGCGACAAGAAGTTCAACGGCACCGGCCCCTGCAAGAACGTGTCCACCGTGCAGTGCACCCACGGCA
TCAAGCCCGTGGTGTCCACCCAGCTGCTGCTGAACGGCTCCCTGGCCGAGGAGGAGATCATCATCCGCTCCGAGAACATCACCGACAACACC
AAGGTGATCATCGTGCAGCTGAACGAGACCATCGAGATCAACTGCACCCGCCCCAACAACAACACCCGCAAGTCCATCCGCATCGGCCCCGG
CCAGGCCTTCTACGCCACCGGCGACATCATCGGCGACATCCGCCAGGCCCACTGCAACGTGTCCCGCACCAAGTGGAACGAGATGCTGCAGA
AGGTGAAGGCCCAGCTGAAGAAGATCTTCAACAAGTCCATCACCTTCAACTCCTCCTCCGGCGGCGACCTGGAGATCACCACCCACTCCTTC
AACTGCCGCGGCGAGTTCTTCTACTGCAACACCTCCGGCCTGTTCAACAACTCCCTGCTGAACTCCACCAACTCCACCATCACCCTGCCCTG
CAAGATCAAGCAGATCGTGCGCATGTGGCAGCGCGTGGGCCAGGCCATGTACGCCCCCCCCATCGCCGGCAACATCACCTGCCGCTCCAACA
TCACCGGCCTGCTGCTGACCCGCGACGGCGGCAACAACAACACCGAGACCTTCCGCCCCGGCGGCGGCGACATGCGCGACAACTGGCGCTCC
GAGCTGTACAAGTACAAGATCGTGAAGATCAAGCCCCTGGGCGTGGCCCCCACCCGCGCCCGCCGCCGCGTGGTGGAGCGCGAGAAGCGCGC
CGTGGGCCTGGGCGCCGTGCTGCTGGGCTTCCTGGGCGCCGCCGGCTCCACCATGGGCGCCGCCTCCATCACCCTGACCGTGCAGGTGCGCC
AGCTGCTGTCCGGCATCGTGCAGCAGCAGTCCAACCTGCTGCGCGCCATCGAGGCCCAGCAGCACCTGCTGCAGCTGACCGTGTGGGGCATC
AAGCAGCTGCAGGCCCGCGTGCTGGCCGTGGAGCGCTACCTGAAGGACCAGCAGCTGCTGGGCATCTGGGGCTGCTCCGGCAAGCTGATCTG
CACCACCAACGTGCCCTGGAACACCTCCTGGTCCAACAAGTCCTACAACGAGATCTGGGACAACATGACCTGGATCGAGTGGGAGCGCGAGA
TCTCCAACTACACCCAGCAGATCTACTCCCTGATCGAGGAGTCCCAGAACCAGCAGGAGAAGAACGAGCAGGACCTGCTGGCCCTGGACAAG
TGGGCCTCCCTGTGGAACTGGTTCGACATCACCAAGTGGCTGTGGTACATCAAGATCTTCATCATGATCGTGGGCGGCCTGATCGGCCTGCG
CATCGTGTTCGCCGTGCTGTCCATCGTGAACCGCGTGCGCCAGGGCTACTCCCCCCTGTCCTTCCAGACCCTGACCCACCACCAGCGCGAGC
CCGACCGCCCCGAGCGCATCGAGGAGGGCGGCGGCGAGCAGGACAAGGACCGCTCCATCCGCCTGGTGTCCGGCTTCCTGGCCCTGGCCTGG
GACGACCTGCGCTCCCTGTGCCTGTTCTCCTACCACCGCCTGCGCGACTTCATCCTGATCGCCGCCCGCACCGTGGAGCTGCTGGGCCGCTC
CTCCCTGAAGGGCCTGCGCCTGGGCTGGGAGGGCCTGAAGTACCTGTGGAACCTGCTGCTGTACTGGGGCCAGGAGCTGAAGAACTCCGCCA
TCAACCTGCTGGACACCATCGCCATCGCCGTGGCCAACTGGACCGACCGCGTGATCGAGGTGGCCCAGCGCGCCTGCCGCGCCATCCTGAAC
ATCCCCCGCCGCATCCGCCAGGGCCTGGAGCGCGCCCTGCTGTAA

Fig. 52B

2003 CON_H Env.seq.opt

ACCCGCGTGATGGAGACCCAGCGCAACTACCCCTCCCTGTGGCGCTGGGGCACCCTGATCCTGGGCATGCTGCTGATCTGCTCCGCCGCCGG
CAACCTGTGGGTGACCGTGTACTACGGCGTGCCCGTGTGGAAGGAGGCCAAGACCACCCTGTTCTGCGCCTCCGACGCCAAGGCCTACGAGA
CCGAGAAGCACAACGTGTGGGCCACCCACGCCTGCGTGCCCACCGACCCCAACCCCCAGGAGATGGTGCTGGAGAACGTGACCGAGAACTTC
AACATGTGGGAGAACGACATGGTGGAGCAGATGCACACCGACATCATCTCCCTGTGGGACCAGTCCCTGAAGCCCTGCGTGAAGCTGACCCC
CCTGTGCGTGACCCTGGACTGCTCCAACGTGAACACCACCAACGCCACCAACTCCCGCTTCAACATGCAGGAGGAGCTGACCAACTGCTCCT
TCAACGTGACCACCGTGATCCGCGACAAGCAGCAGAAGGTGCACGCCCTGTTCTACCGCCTGGACGTGGTGCCCATCGACGACAACAACTCC
TACCAGTACCGCCTGATCAACTGCAACACCTCCGTGATCACCCAGGCCTGCCCCAAGGTGTCCTTCGAGCCCATCCCCATCCACTACTGCGC
CCCCGCCGGCTTCGCCATCCTGAAGTGCAACAACAAGACCTTCAACGGCACCGGCCCCTGCACCAACGTGTCCACCGTGCAGTGCACCCACG
GCATCCGCCCCGTGGTGTCCACCCAGCTGCTGCTGAACGGCTCCCTGGCCGAGGAGCAGGTGATCATCCGCTCCAAGAACATCTCCGACAAC
ACCAAGAACATCATCGTGCAGCTGAACAAGCCCGTGGAGATCACCTGCACCCGCCCCAACAACAACACCCGCAAGTCCATCCACCTGGGCCC
CGGCCAGGCCTTCTACGCCACCGGCGACATCATCGGCGACATCCGCCAGGCCCACTGCAACATCTCCGGCAAGAAGTGGAACAAGACCCTGC
ACCAGGTGGTGACCCAGCTGGGCAAGTACTTCGACAACCGCACCATCATCTTCAAGCCCCACTCCGGCGGCGACATGGAGGTGACCACCCAC
TCCTTCAACTGCCGCGGCGAGTTCTTCTACTGCAACACCTCCGGCCTGTTCAACTCCTCCTGGACCAACTCCACCAACGACACCAAGAACAT
CATCACCCTGCCCTGCCGCATCAAGCAGATCGTGAACATGTGGCAGCGCGTGGGCCAGGCCATGTACGCCCCCCCCATCAAGGGCAACATCA
CCTGCGTGTCCAACATCACCGGCCTGATCCTGACCTTCGACGAGGGCAACAACACCGTGACCTTCCGCCCCGGCGGCGGCGACATGCGCGAC
AACTGGCGCTCCGAGCTGTACAAGTACAAGGTGGTGAAGATCGAGCCCCTGGGCGTGGCCCCCACCGAGGCCCGCCGCCGCGTGGTGGAGCG
CGAGAAGCGCGCCGTGGGCATGGGCGCCTTCTTCCTGGGCTTCCTGGGCGCCGCCGGCTCCACCATGGGCGCCGCCTCCATCACCCTGACCG
TGCAGGCCCGCCAGCTGCTGTCCGGCATCGTGCAGCAGCAGTCCAACCTGCTGCGCGCCATCCAGGCCCAGCAGCACATGCTGCAGCTGACC
GTGTGGGGCATCAAGCAGCTGCAGGCCCGCGTGCTGGCCGTGGAGCGCTACCTGAAGGACCAGCAGCTGCTGGGCATCTGGGGCTGCTCCGG
CAAGCTGATCTGCACCACCAACGTGCCCTGGAACTCCTCCTGGTCCAACAAGTCCCTGGACGAGATCTGGGACAACATGACCTGGATGGAGT
GGGACAAGCAGATCAACAACTACACCGAGGAGATCTACCGCCTGCTGGAGGTGTCCCAGACCCAGCAGGAGAAGAACGAGCAGGACCTGCTG
GCCCTGGACAAGTGGGCCTCCCTGTGGAACTGGTTCTCCATCACCAACTGGCTGTGGTACATCAAGATCTTCATCATGATCGTGGGCGGCCT
GATCGGCCTGCGCATCATCTTCGCCGTGCTGTCCATCGTGAACCGCGTGCGCCAGGGCTACTCCCCCCTGTCCTTCCAGACCCTGATCCCCA
ACCCCCGCGGCCCCGACCGCCCCGAGGGCATCGAGGAGGAGGGCGGCGAGCAGGACCGCGACCGCTCCGTGCGCCTGGTGAACGGCTTCCTG
CCCCTGGTGTGGGACGACCTGCGCTCCCTGTGCCTGTTCTCCTACCGCCTGCTGCGCGACCTGCTGCTGATCGTGGTGCGCACCGTGGAGCT
GCTGGGCCGCCGCGGCCGCGAGGCCCTGAAGTACCTGTGGAACCTGCTGCAGTACTGGGGCCAGGAGCTGAAGAACTCCGCCATCAACCTGC
TGAACACCACCGCCATCGCCGTGGCCGAGGGCACCGACCGCATCATCGAGATCGTGCAGCGCGCCTGGCGCGCCATCCTGCACATCCCCCGC
CGCATCCGCCAGGGCTTCGAGCGCACCCTGCTGTAA

Fig. 53A

2003 CON_01_AE Env

MRVKETQMNWPNLWKWGTLILGLVIICSASDNLWVTVYYGVPVWRDADTTLFCASDAKAHETEVHNVWATHACVPTDPNPQEIHLENVTENF
NMWKNNMVEQMQEDVISLWDQSLKPCVKLTPLCVTLNCTNANLTNVNNITNVSNIIGNITNEVRNCSFNMTTELRDKKQKVHALFYKLDIVQ
IEDNNSYRLINCNTSVIKQACPKISFDPIPIHYCTPAGYAILKCNDKNFNGTGPCKNVSSVQCTHGIKPVVSTQLLLNGSLAEEEIIIRSEN
LTNNAKTIIVHLNKSVEINCTRPSNNTRTSITIGPGQVFYRTGDIIGDIRKAYCEINGTKWNEVLKQVTEKLKEHFNNKTIIFQPPSGGDLE
ITMHHFNCRGEFFYCNTTKLFNNTCIGNETMEGCNGTIILPCKIKQIINMWQGAGQAMYAPPISGRINCVSNITGILLTRDGGANNTNETFR
PGGGNIKDNWRSELYKYKVVQIEPLGIAPTRAKRRVVEREKRAVGIGAMIFGFLGAAGSTMGAASITLTVQARQLLSGIVQQQSNLLRAIEA
QQHLLQLTVWGIKQLQARVLAVERYLKDQKFLGLWGCSGKIICTTAVPWNSTWSNRSFEEIWNNMTWIEWEREISNYTNQIYEILTESQNQQ
DRNEKDLLELDKWASLWNWFDITNWLWYIKIFIMIVGGLIGLRIIFAVLSIVNRVRQGYSPLSFQTPTHHQREPDRPERIEEGGGEQGRDRS
VRLVSGFLALAWDDLRSLCLFSYHRLRDFILIAARTVELLGHSSLKGLRRGWEGLKYLGNLLLYWGQELKISAISLLDATAIAVAGWTDRVI
EVAQGAWRAILHIPRRIRQGLERALL$

Fig. 54A

2003 CON_02_AG Env

MRVMGIQKNYPLLWRWGMIIFWIMIICNAENLWVTVYYGVPVWRDAETTLFCASDAKAYDTEVHNVWATHACVPTDPNPQEIHLENVTENFN
MWKNNMVEQMHEDIISLWDQSLKPCVKLTPLCVTLDCHNNITNSNTTNNNAGEIKNCSFNMTTELRDKKQKVYALFYRLDVVQINKNNSQYR
LINCNTSAITQACPKVSFEPIPIHYCAPAGFAILKCNDKEFNGTGPCKNVSTVQCTHGIKPVVSTQLLLNGSLAEEEIVIRSENITNNAKTI
IVQLVKPVKINCTRPNNNTRKSVRIGPGQTFYATGDIIGDIRQAHCNVSRTKWNNTLQQVATQLRKYFNKTIIFANPSGGDLEITTHSFNCG
GEFFYCNTSELFNSTWNSTWNNTEKCITLQCRIKQIVNMWQKVGQAMYAPPIQGVIRCESNITGLLLTRDGGNNNSTNETFRPGGGDMRDNW
RSELYKYKVVKIEPLGVAPTRAKRRVVEREKRAVGLGAVFLGFLGAAGSTMGAASITLTVQARQLLSGIVQQQSNLLRAIEAQQHLLKLTVW
GIKQLQARVLALERYLKDQQLLGIWGCSGKLICTTTVPWNSSWSNKTYNDIWDNMTWLQWDKEISNYTDIIYNLIEESQNQQEKNEQDLLAL
DKWASLWNWFDITNWLWYIKIFIMIVGGLIGLRIVFAVLTIINRVRQGYSPLSFQTLTHHQREPDRPERIEEGGGEQDRDRSVRLVSGFLAL
AWDDLRSLCLFSYHRLRDFVLIAARTVELLGHSSLKGLRLGWEALKYLGNLLSYWGQELKNSAINLLDTIAIAVANWTDRVIEIGQRAGRAI
LNIPRRIRQGLERALL$

*Fig. 53B*

2003 CON_01_AE Env.seq.opt

ATGCGCGTGAAGGAGACCCAGATGAACTGGCCCAACCTGTGGAAGTGGGGCACCCTGATCCTGGGCCTGGTGATCATCTGCTCCGCCTCCGA
CAACCTGTGGGTGACCGTGTACTACGGCGTGCCCGTGTGGCGCGACGCCGACACCACCCTGTTCTGCGCCTCCGACGCCAAGGCCCACGAGA
CCGAGGTGCACAACGTGTGGGCCACCCACGCCTGCGTGCCCACCGACCCCAACCCCCAGGAGATCCACCTGGAGAACGTGACCGAGAACTTC
AACATGTGGAAGAACAACATGGTGGAGCAGATGCAGGAGGACGTGATCTCCCTGTGGGACCAGTCCCTGAAGCCCTGCGTGAAGCTGACCCC
CCTGTGCGTGACCCTGAACTGCACCAACGCCAACCTGACCAACGTGAACAACATCACCAACGTGTCCAACATCATCGGCAACATCACCAACG
AGGTGCGCAACTGCTCCTTCAACATGACCACCGAGCTGCGCGACAAGAAGCAGAAGGTGCACGCCCTGTTCTACAAGCTGGACATCGTGCAG
ATCGAGGACAACAACTCCTACCGCCTGATCAACTGCAACACCTCCGTGATCAAGCAGGCCTGCCCCAAGATCTCCTTCGACCCCATCCCCAT
CCACTACTGCACCCCCGCCGGCTACGCCATCCTGAAGTGCAACGACAAGAACTTCAACGGCACCGGCCCCTGCAAGAACGTGTCCTCCGTGC
AGTGCACCCACGGCATCAAGCCCGTGGTGTCCACCCAGCTGCTGCTGAACGGCTCCCTGGCCGAGGAGGAGATCATCATCCGCTCCGAGAAC
CTGACCAACAACGCCAAGACCATCATCGTGCACCTGAACAAGTCCGTGGAGATCAACTGCACCCGCCCCTCCAACAACACCCGCACCTCCAT
CACCATCGGCCCCGGCCAGGTGTTCTACCGCACCGGCGACATCATCGGCGACATCCGCAAGGCCTACTGCGAGATCAACGGCACCAAGTGGA
ACGAGGTGCTGAAGCAGGTGACCGAGAAGCTGAAGGAGCACTTCAACAACAAGACCATCATCTTCCAGCCCCCCTCCGGCGGCGACCTGGAG
ATCACCATGCACCACTTCAACTGCCGCGGCGAGTTCTTCTACTGCAACACCACCAAGCTGTTCAACAACACCTGCATCGGCAACGAGACCAT
GGAGGGCTGCAACGGCACCATCATCCTGCCCTGCAAGATCAAGCAGATCATCAACATGTGGCAGGGCGCCGGCCAGGCCATGTACGCCCCCC
CCATCTCCGGCCGCATCAACTGCGTGTCCAACATCACCGGCATCCTGCTGACCCGCGACGGCGGCGCCAACAACACCAACGAGACCTTCCGC
CCCGGCGGCGGCAACATCAAGGACAACTGGCGCTCCGAGCTGTACAAGTACAAGGTGGTGCAGATCGAGCCCCTGGGCATCGCCCCCACCCG
CGCCAAGCGCCGCGTGGTGGAGCGCGAGAAGCGCGCCGTGGGCATCGGCGCCATGATCTTCGGCTTCCTGGGCGCCGCCGGCTCCACCATGG
GCGCCGCCTCCATCACCCTGACCGTGCAGGCCCGCCAGCTGCTGTCCGGCATCGTGCAGCAGCAGTCCAACCTGCTGCGCGCCATCGAGGCC
CAGCAGCACCTGCTGCAGCTGACCGTGTGGGGCATCAAGCAGCTGCAGGCCCGCGTGCTGGCCGTGGAGCGCTACCTGAAGGACCAGAAGTT
CCTGGGCCTGTGGGGCTGCTCCGGCAAGATCATCTGCACCACCGCCGTGCCCTGGAACTCCACCTGGTCCAACCGCTCCTTCGAGGAGATCT
GGAACAACATGACCTGGATCGAGTGGGAGCGCGAGATCTCCAACTACACCAACCAGATCTACGAGATCCTGACCGAGTCCCAGAACCAGCAG
GACCGCAACGAGAAGGACCTGCTGGAGCTGGACAAGTGGGCCTCCCTGTGGAACTGGTTCGACATCACCAACTGGCTGTGGTACATCAAGAT
CTTCATCATGATCGTGGGCGGCCTGATCGGCCTGCGCATCATCTTCGCCGTGCTGTCCATCGTGAACCGCGTGCGCCAGGGCTACTCCCCCC
TGTCCTTCCAGACCCCCACCCACCACCAGCGCGAGCCCGACCGCCCCGAGCGCATCGAGGAGGGCGGCGGCGAGCAGGGCCGCGACCGCTCC
GTGCGCCTGGTGTCCGGCTTCCTGGCCCTGGCCTGGGACGACCTGCGCTCCCTGTGCCTGTTCTCCTACCACCGCCTGCGCGACTTCATCCT
GATCGCCGCCCGCACCGTGGAGCTGCTGGGCCACTCCTCCCTGAAGGGCCTGCGCCGCGGCTGGGAGGGCCTGAAGTACCTGGGCAACCTGC
TGCTGTACTGGGGCCAGGAGCTGAAGATCTCCGCCATCTCCCTGCTGGACGCCACCGCCATCGCCGTGGCCGGCTGGACCGACCGCGTGATC
GAGGTGGCCCAGGGCGCCTGGCGCGCCATCCTGCACATCCCCCGCCGCATCCGCCAGGGCCTGGAGCGCGCCCTGCTGTAA

Fig. 54B

2003 CON_02_AG Env.seq.opt

ATGCGCGTGATGGGCATCCAGAAGAACTACCCCCTGCTGTGGCGCTGGGGCATGATCATCTTCTGGATCATGATCATCTGCAACGCCGAGAA
CCTGTGGGTGACCGTGTACTACGGCGTGCCCGTGTGGCGCGACGCCGAGACCACCCTGTTCTGCGCCTCCGACGCCAAGGCCTACGACACCG
AGGTGCACAACGTGTGGGCCACCCACGCCTGCGTGCCCACCGACCCCAACCCCCAGGAGATCCACCTGGAGAACGTGACCGAGAACTTCAAC
ATGTGGAAGAACAACATGGTGGAGCAGATGCACGAGGACATCATCTCCCTGTGGGACCAGTCCCTGAAGCCCTGCGTGAAGCTGACCCCCCT
GTGCGTGACCCTGGACTGCCACAACAACATCACCAACTCCAACACCACCAACAACAACGCCGGCGAGATCAAGAACTGCTCCTTCAACATGA
CCACCGAGCTGCGCGACAAGAAGCAGAAGGTGTACGCCCTGTTCTACCGCCTGGACGTGGTGCAGATCAACAAGAACAACTCCCAGTACCGC
CTGATCAACTGCAACACCTCCGCCATCACCCAGGCCTGCCCCAAGGTGTCCTTCGAGCCCATCCCCATCCACTACTGCGCCCCCGCCGGCTT
CGCCATCCTGAAGTGCAACGACAAGGAGTTCAACGGCACCGGCCCCTGCAAGAACGTGTCCACCGTGCAGTGCACCCACGGCATCAAGCCCG
TGGTGTCCACCCAGCTGCTGCTGAACGGCTCCCTGGCCGAGGAGGAGATCGTGATCCGCTCCGAGAACATCACCAACAACGCCAAGACCATC
ATCGTGCAGCTGGTGAAGCCCGTGAAGATCAACTGCACCCGCCCCAACAACAACACCCGCAAGTCCGTGCGCATCGGCCCCGGCCAGACCTT
CTACGCCACCGGCGACATCATCGGCGACATCCGCCAGGCCCACTGCAACGTGTCCCGCACCAAGTGGAACAACACCCTGCAGCAGGTGGCCA
CCCAGCTGCGCAAGTACTTCAACAAGACCATCATCTTCGCCAACCCCTCCGGCGGCGACCTGGAGATCACCACCCACTCCTTCAACTGCGGC
GGCGAGTTCTTCTACTGCAACACCTCCGAGCTGTTCAACTCCACCTGGAACTCCACCTGGAACAACACCGAGAAGTGCATCACCCTGCAGTG
CCGCATCAAGCAGATCGTGAACATGTGGCAGAAGGTGGGCCAGGCCATGTACGCCCCCCCCATCCAGGGCGTGATCCGCTGCGAGTCCAACA
TCACCGGCCTGCTGCTGACCCGCGACGGCGGCAACAACAACTCCACCAACGAGACCTTCCGCCCCGGCGGCGGCGACATGCGCGACAACTGG
CGCTCCGAGCTGTACAAGTACAAGGTGGTGAAGATCGAGCCCCTGGGCGTGGCCCCCACCCGCGCCAAGCGCCGCGTGGTGGAGCGCGAGAA
GCGCGCCGTGGGCCTGGGCGCCGTGTTCCTGGGCTTCCTGGGCGCCGCCGGCTCCACCATGGGCGCCGCCTCCATCACCCTGACCGTGCAGG
CCCGCCAGCTGCTGTCCGGCATCGTGCAGCAGCAGTCCAACCTGCTGCGCGCCATCGAGGCCCAGCAGCACCTGCTGAAGCTGACCGTGTGG
GGCATCAAGCAGCTGCAGGCCCGCGTGCTGGCCCTGGAGCGCTACCTGAAGGACCAGCAGCTGCTGGGCATCTGGGGCTGCTCCGGCAAGCT
GATCTGCACCACCACCGTGCCCTGGAACTCCTCCTGGTCCAACAAGACCTACAACGACATCTGGGACAACATGACCTGGCTGCAGTGGGACA
AGGAGATCTCCAACTACACCGACATCATCTACAACCTGATCGAGGAGTCCCAGAACCAGCAGGAGAAGAACGAGCAGGACCTGCTGGCCCTG
GACAAGTGGGCCTCCCTGTGGAACTGGTTCGACATCACCAACTGGCTGTGGTACATCAAGATCTTCATCATGATCGTGGGCGGCCTGATCGG
CCTGCGCATCGTGTTCGCCGTGCTGACCATCATCAACCGCGTGCGCCAGGGCTACTCCCCCCTGTCCTTCCAGACCCTGACCCACCACCAGC
GCGAGCCCGACCGCCCCGAGCGCATCGAGGAGGGCGGCGGCGAGCAGGACCGCGACCGCTCCGTGCGCCTGGTGTCCGGCTTCCTGGCCCTG
GCCTGGGACGACCTGCGCTCCCTGTGCCTGTTCTCCTACCACCGCCTGCGCGACTTCGTGCTGATCGCCGCCCGCACCGTGGAGCTGCTGGG
CCACTCCTCCCTGAAGGGCCTGCGCCTGGGCTGGGAGGCCCTGAAGTACCTGGGCAACCTGCTGTCCTACTGGGGCCAGGAGCTGAAGAACT
CCGCCATCAACCTGCTGGACACCATCGCCATCGCCGTGGCCAACTGGACCGACCGCGTGATCGAGATCGGCCAGCGCGCCGGCCGCGCCATC
CTGAACATCCCCCGCCGCATCCGCCAGGGCCTGGAGCGCGCCCTGCTGTAA

Fig. 55A

2003 CON_03_AB Env

MRVKEIRKHLWRWGTLFLGMLMICSATENLWVTVYYGVPVWKEATTTLFCASDAKAYSKEVHNVWATYACVPTDPSPQEIPLENVTENFNMG
KNNMVEQMHEDIISLWDQSLKPCVKLTPLCVTLNCTDLKKNVTSTNTSSIKMMEMKNCSFNITTDLRDKVKKEYALFYKLDVVQIDNDSYRL
ISCNTSVVTQACPKISFEPIPIHYCAPAGFAILKCNDKKFNGTGPCTNVSTVQCTHGIKPVVSTQLLLNGSLAEEEVVIRSVNFTDNTKTII
VQLKEPVEINCTRPNNNTRKGIHIGPGRAFYATGDIIGDIRQAHCNISITKWNNTLKQIVIKLRKQFGNKTIVFNQSSGGDPEIVMHSFNCG
GEFFYCNTTKLFNSTWNGTEELNNTEGDIVTLPCRIKQIINMWQEVGKAMYAPPIAGQIRCSSNITGLLLTRDGGNQSNVTEIFRPGGGDMR
DNWRSELYKYKVVKIEPLGVAPTKAKRRVVQREKRAVGIGAVFLGFLGAAGSTMGAASITLTVQARQLLSGIVQQQNNLLRAIEAQQHLLQL
TVWGIKQLQARVLAVERYLKDQQLLGIWGCSGKLICTTAVPWNTSWSNKSLDEIWNNMTWMEWEREINNYTGLIYNLIEESQNQQEKNEQEI
LALDKWASLWNWFDISKWLWYIKIFIMIVGGLVGLRIIFAVLSIVNRVRQGYSPLSFQTRLPTQRGPDRPEGIEEEGGERDRDTSIRLVNGF
LALIWDDLRSLCLFIYHHLRDLLLIAARIVELLGRRGWEALKYWWNLLQYWIQELKSSAINLIDTIAIAVAGWTDRVIEIGQRFCRAIRNIP
RRIRQGAEKALQ$

Fig. 56A

2003 CON_04_CPX Env

MRVMGIQRNYPHLWEWGTLILGLVIICSASKNLWVTVYYGVPVWRDAETTPFCASDAKAYDKEVHNIWATHACVPTDPNPQEIALKNVTENF
NMWKNNMVEQMHEDIISLWDEGLKPCVKLTPLCVALNCSNATINNSTKTNSTEEIKNCSFNITTEIRDKKKKEYALFYRLDIVPINDSANNN
SINSEYMLINCNASTIKQACPKVTFEPIPIHYCAPAGFAILKCNDKNFTGLGPCTNVSSVQCTHGIKPVVSTQLLLNGSLATEGVVIRSKNF
TDNTKNIIVQLAKAVKINCTRPNNNTRKSVHIGPGQTWYATGEIIGDIRQAHCNISGNDWNETLQKIVEELRKHFPNKTIIFAPSAGGDLEI
TTHSFNCGGEFFYCNTSELFNSTYMNSTNSTTINKTITLPCRIKQIVSMWQEVGQAMYAPPIAGSINCSSDITGIILTRDGGNNNTNNETFR
PGGGDMRDNWRSELYKYKVVKIEPVGVAPTRARRRVVQREKRAVGIGAVFLGFLGAAGSTMGAASITLTVQARQLLSGIVQQQSNLLRAIEA
QQHLLRLTVWGIKQLQARVLALESYLKDQQLLGIWGCSGKLICTTNVPWNSSWSNKSYNDIWDNMTWLQWDKEINNYTQIIYELLEESQNQQ
EKNEQDLLALDKWANLWNWFNISNWLWYIKIFIMIVGGLIGLRIIFAVLSIVNRVRQGYSPLSLQTLIPTTQRGPDRPEGTEEEGGEQDRSR
SIRLVNGFLPLIWDDLRNLCLFSYRHLRNLLLIVARTVELLGIRGWEALKYLWNLLLYWGQELRNSAINLLDTTAIAVAEGTDRIIEAVQRA
CRAIRNIPRRIRQGLERALL$

Fig. 55B

2003 CON_03_AB Env.seq.opt

ATGCGCGTGAAGGAGATCCGCAAGCACCTGTGGCGCTGGGGCACCCTGTTCCTGGGCATGCTGATGATCTGCTCCGCCACCGAGAACCTGTG
GGTGACCGTGTACTACGGCGTGCCCGTGTGGAAGGAGGCCACCACCACCCTGTTCTGCGCCTCCGACGCCAAGGCCTACTCCAAGGAGGTGC
ACAACGTGTGGGCCACCTACGCCTGCGTGCCCACCGACCCCTCCCCCCAGGAGATCCCCCTGGAGAACGTGACCGAGAACTTCAACATGGGC
AAGAACAACATGGTGGAGCAGATGCACGAGGACATCATCTCCCTGTGGGACCAGTCCCTGAAGCCCTGCGTGAAGCTGACCCCCCTGTGCGT
GACCCTGAACTGCACCGACCTGAAGAAGAACGTGACCTCCACCAACACCTCCTCCATCAAGATGATGGAGATGAAGAACTGCTCCTTCAACA
TCACCACCGACCTGCGCGACAAGGTGAAGAAGGAGTACGCCCTGTTCTACAAGCTGGACGTGGTGCAGATCGACAACGACTCCTACCGCCTG
ATCTCCTGCAACACCTCCGTGGTGACCCAGGCCTGCCCCAAGATCTCCTTCGAGCCCATCCCCATCCACTACTGCGCCCCCGCCGGCTTCGC
CATCCTGAAGTGCAACGACAAGAAGTTCAACGGCACCGGCCCCTGCACCAACGTGTCCACCGTGCAGTGCACCCACGGCATCAAGCCCGTGG
TGTCCACCCAGCTGCTGCTGAACGGCTCCCTGGCCGAGGAGGAGGTGGTGATCCGCTCCGTGAACTTCACCGACAACACCAAGACCATCATC
GTGCAGCTGAAGGAGCCCGTGGAGATCAACTGCACCCGCCCCAACAACAACACCCGCAAGGGCATCCACATCGGCCCCGGCCGCGCCTTCTA
CGCCACCGGCGACATCATCGGCGACATCCGCCAGGCCCACTGCAACATCTCCATCACCAAGTGGAACAACACCCTGAAGCAGATCGTGATCA
AGCTGCGCAAGCAGTTCGGCAACAAGACCATCGTGTTCAACCAGTCCTCCGGCGGCGACCCCGAGATCGTGATGCACTCCTTCAACTGCGGC
GGCGAGTTCTTCTACTGCAACACCACCAAGCTGTTCAACTCCACCTGGAACGGCACCGAGGAGCTGAACAACACCGAGGGCGACATCGTGAC
CCTGCCCTGCCGCATCAAGCAGATCATCAACATGTGGCAGGAGGTGGGCAAGGCCATGTACGCCCCCCCCATCGCCGGCCAGATCCGCTGCT
CCTCCAACATCACCGGCCTGCTGCTGACCCGCGACGGCGGCAACCAGTCCAACGTGACCGAGATCTTCCGCCCCGGCGGCGGCGACATGCGC
GACAACTGGCGCTCCGAGCTGTACAAGTACAAGGTGGTGAAGATCGAGCCCCTGGGCGTGGCCCCCACCAAGGCCAAGCGCCGCGTGGTGCA
GCGCGAGAAGCGCGCCGTGGGCATCGGCGCCGTGTTCCTGGGCTTCCTGGGCGCCGCCGGCTCCACCATGGGCGCCGCCTCCATCACCCTGA
CCGTGCAGGCCCGCCAGCTGCTGTCCGGCATCGTGCAGCAGCAGAACAACCTGCTGCGCGCCATCGAGGCCCAGCAGCACCTGCTGCAGCTG
ACCGTGTGGGGCATCAAGCAGCTGCAGGCCCGCGTGCTGGCCGTGGAGCGCTACCTGAAGGACCAGCAGCTGCTGGGCATCTGGGGCTGCTC
CGGCAAGCTGATCTGCACCACCGCCGTGCCCTGGAACACCTCCTGGTCCAACAAGTCCCTGGACGAGATCTGGAACAACATGACCTGGATGG
AGTGGGAGCGCGAGATCAACAACTACACCGGCCTGATCTACAACCTGATCGAGGAGTCCCAGAACCAGCAGGAGAAGAACGAGCAGGAGATC
CTGGCCCTGGACAAGTGGGCCTCCCTGTGGAACTGGTTCGACATCTCCAAGTGGCTGTGGTACATCAAGATCTTCATCATGATCGTGGGCGG
CCTGGTGGGCCTGCGCATCATCTTCGCCGTGCTGTCCATCGTGAACCGCGTGCGCCAGGGCTACTCCCCCCTGTCCTTCCAGACCCGCCTGC
CCACCCAGCGCGGCCCCGACCGCCCCGAGGGCATCGAGGAGGAGGGCGGCGAGCGCGACCGCGACACCTCCATCCGCCTGGTGAACGGCTTC
CTGGCCCTGATCTGGGACGACCTGCGCTCCCTGTGCCTGTTCATCTACCACCACCTGCGCGACCTGCTGCTGATCGCCGCCCGCATCGTGGA
GCTGCTGGGCCGCCGCGGCTGGGAGGCCCTGAAGTACTGGTGGAACCTGCTGCAGTACTGGATCCAGGAGCTGAAGTCCTCCGCCATCAACC
TGATCGACACCATCGCCATCGCCGTGGCCGGCTGGACCGACCGCGTGATCGAGATCGGCCAGCGCTTCTGCCGCGCCATCCGCAACATCCCC
CGCCGCATCCGCCAGGGCGCCGAGAAGGCCCTGCAGTAA

Fig. 56B

2003 CON_04_CPX Env.seq.opt

ATGCGCGTGATGGGCATCCAGCGCAACTACCCCCACCTGTGGGAGTGGGGCACCCTGATCCTGGGCCTGGTGATCATCTGCTCCGCCTCCAA
GAACCTGTGGGTGACCGTGTACTACGGCGTGCCCGTGTGGCGCGACGCCGAGACCACCCCCTTCTGCGCCTCCGACGCCAAGGCCTACGACA
AGGAGGTGCACAACATCTGGGCCACCCACGCCTGCGTGCCCACCGACCCCAACCCCCAGGAGATCGCCCTGAAGAACGTGACCGAGAACTTC
AACATGTGGAAGAACAACATGGTGGAGCAGATGCACGAGGACATCATCTCCCTGTGGGACGAGGGCCTGAAGCCCTGCGTGAAGCTGACCCC
CCTGTGCGTGGCCCTGAACTGCTCCAACGCCACCATCAACAACTCCACCAAGACCAACTCCACCGAGGAGATCAAGAACTGCTCCTTCAACA
TCACCACCGAGATCCGCGACAAGAAGAAGAAGGAGTACGCCCTGTTCTACCGCCTGGACATCGTGCCCATCAACGACTCCGCCAACAACAAC
TCCATCAACTCCGAGTACATGCTGATCAACTGCAACGCCTCCACCATCAAGCAGGCCTGCCCCAAGGTGACCTTCGAGCCCATCCCCATCCA
CTACTGCGCCCCCGCCGGCTTCGCCATCCTGAAGTGCAACGACAAGAACTTCACCGGCCTGGGCCCCTGCACCAACGTGTCCTCCGTGCAGT
GCACCCACGGCATCAAGCCCGTGGTGTCCACCCAGCTGCTGCTGAACGGCTCCCTGGCCACCGAGGGCGTGGTGATCCGCTCCAAGAACTTC
ACCGACAACACCAAGAACATCATCGTGCAGCTGGCCAAGGCCGTGAAGATCAACTGCACCCGCCCCAACAACAACACCCGCAAGTCCGTGCA
CATCGGCCCCGGCCAGACCTGGTACGCCACCGGCGAGATCATCGGCGACATCCGCCAGGCCCACTGCAACATCTCCGGCAACGACTGGAACG
AGACCCTGCAGAAGATCGTGGAGGAGCTGCGCAAGCACTTCCCCAACAAGACCATCATCTTCGCCCCCTCCGCCGGCGGCGACCTGGAGATC
ACCACCCACTCCTTCAACTGCGGCGGCGAGTTCTTCTACTGCAACACCTCCGAGCTGTTCAACTCCACCTACATGAACTCCACCAACTCCAC
CACCATCAACAAGACCATCACCCTGCCCTGCCGCATCAAGCAGATCGTGTCCATGTGGCAGGAGGTGGGCCAGGCCATGTACGCCCCCCCCA
TCGCCGGCTCCATCAACTGCTCCTCCGACATCACCGGCATCATCCTGACCCGCGACGGCGGCAACAACAACACCAACAACGAGACCTTCCGC
CCCGGCGGCGGCGACATGCGCGACAACTGGCGCTCCGAGCTGTACAAGTACAAGGTGGTGAAGATCGAGCCCGTGGGCGTGGCCCCCACCCG
CGCCCGCCGCCGCGTGGTGCAGCGCGAGAAGCGCGCCGTGGGCATCGGCGCCGTGTTCCTGGGCTTCCTGGGCGCCGCCGGCTCCACCATGG
GCGCCGCCTCCATCACCCTGACCGTGCAGGCCCGCCAGCTGCTGTCCGGCATCGTGCAGCAGCAGTCCAACCTGCTGCGCGCCATCGAGGCC
CAGCAGCACCTGCTGCGCCTGACCGTGTGGGGCATCAAGCAGCTGCAGGCCCGCGTGCTGGCCCTGGAGTCCTACCTGAAGGACCAGCAGCT
GCTGGGCATCTGGGGCTGCTCCGGCAAGCTGATCTGCACCACCAACGTGCCCTGGAACTCCTCCTGGTCCAACAAGTCCTACAACGACATCT
GGGACAACATGACCTGGCTGCAGTGGGACAAGGAGATCAACAACTACACCCAGATCATCTACGAGCTGCTGGAGGAGTCCCAGAACCAGCAG
GAGAAGAACGAGCAGGACCTGCTGGCCCTGGACAAGTGGGCCAACCTGTGGAACTGGTTCAACATCTCCAACTGGCTGTGGTACATCAAGAT
CTTCATCATGATCGTGGGCGGCCTGATCGGCCTGCGCATCATCTTCGCCGTGCTGTCCATCGTGAACCGCGTGCGCCAGGGCTACTCCCCCC
TGTCCCTGCAGACCCTGATCCCCACCACCCAGCGCGGCCCCGACCGCCCCGAGGGCACCGAGGAGGAGGGCGGCGAGCAGGACCGCTCCCGC
TCCATCCGCCTGGTGAACGGCTTCCTGCCCCTGATCTGGGACGACCTGCGCAACCTGTGCCTGTTCTCCTACCGCCACCTGCGCAACCTGCT
GCTGATCGTGGCCCGCACCGTGGAGCTGCTGGGCATCCGCGGCTGGGAGGCCCTGAAGTACCTGTGGAACCTGCTGCTGTACTGGGGCCAGG
AGCTGCGCAACTCCGCCATCAACCTGCTGGACACCACCGCCATCGCCGTGGCCGAGGGCACCGACCGCATCATCGAGGCCGTGCAGCGCGCC
TGCCGCGCCATCCGCAACATCCCCCGCCGCATCCGCCAGGGCCTGGAGCGCGCCCTGCTGTAA

Fig. 57A

2003 CON_06_CPX Env

MRVKGIQKNWQHLWKWGTLILGLVIICSASNNMWVTVYYGVPAWEDADTILFCASDAKAYSAEKHNVWATHACVPTDPNPQEIALENVTENF
NMWKNHMVEQMHEDIISLWDESLKPCVKLTPLCVTLNCTNVTKNNNTKIMGREEIKNCSFNVTTEIRDKKKKEYALFYRLDVVPIDDNNNSY
RLINCNASTIKQACPKVSFEPIPIHYCAPAGFAILKCRDKNFNGTGPCKNVSTVQCTHGIKPVVSTQLLLNGSLAEEEIIIKSENLTDNTKT
IIVQLNKSVEIRCTRPNNNTRKSISFGPGQAFYATGDIIGDIRQAHCNVSRTDWNNMLQNVTAKLKELFNKNITFNSSAGGDLEITTHSFNC
GGEFFYCNTSQLFNSTRPNETNTITLPCKIKQIVRMWQRVGQAMYAPPIAGNITCTSNITGLLLTRDGNNNDSETFRPGGGDMRDNWRSELY
KYKVVKIKPLGIAPTRARRRVVGREKRAVGLGAVFLGFLGTAGSTMGAASITLTVQVRQLLSGIVQQQSNLLRAIEAQQHLLQLTVWGIKQL
QARVLAVERYLKDQQLLGIWGCSGKLICPTNVPWNASWSNKTYNEIWDNMTWIEWDREINNYTQQIYSLIEESQNQQEKNEQDLLALDKWAS
LWSWFDISNWLWYIKIFIMIVGGLIGLRIVFAVLSIVNRVRQGYSPLSLQTLIPNPTGADRPGEIEEGGGEQGRTRSIRLVNGFLALAWDDL
RSLCLFSYHRLRDFVLIAARTVETLGHRGWEILKYLGNLVCYWGQELKNSAISLLDTTAIAVANWTDRVIEVVQRVFRAFLNIPRRIRQGFE
RALL$

Fig. 58A

2003 CON_08_BC Env

MRVRGTRRNYQQWWIWGVLGFWMLMICNVEGNLWVTVYYGVPVWKEAKTTLFCASDAKAYETEVHNVWATHACVPTDPNPQEIVMENVTENF
NMWNNDMVNQMHEDVISLWDQSLKPCVKLTPLCVTLECTNVSSNGNGTYNETYNESVKEIKNCSFNATTLLRDRKKTVYALFYRLDIVPLND
ENSGKNSSEYYRLINCNTSAITQACPKVTFDPIPIHYCTPAGYAILKCNDKKFNGTGQCHNVSTVQCTHGIKPVVSTQLLLNGSLAEREIII
RSENLTNNVKTIIVHLNQSVEIVCTRPNNNTRKSIRIGPGQTFYATGDIIGDIRQAHCNISKDKWYETLQRVSKKLAEHFPNKTIKFASSSG
GDLEITTHSFNCRGEFFYCNTSGLFNGTYMNGTNNSSSIITIPCRIKQIINMWQEVGRAMYAPPIEGNITCKSNITGLLLVRDGGRTESNNT
EIFRPGGGDMRNNWRNELYKYKVVEIKPLGVAPTAAKRRVVEREKRAVGLGAVFLGFLGAAGSTMGAASITLTVQARQLLSGIVQQQSNLLR
AIEAQQHMLQLTVWGIKQLQTRVLAIERYLKDQQLLGIWGCSGKLICTTAVPWNSSWSNKSQQEIWDNMTWMQWDKEISNYTNTIYRLLEDS
QNQQERNEKDLLALDSWKNLWSWFDITNWLWYIKIFIMIVGGLIGLRIIFAVLSIVNRVRQGYSPLSFQILTPNPGGPGRLGRIEEEGGEQD
KTRSIRLVNGFLALAWDDLRNLCLFSYHRLRDFILLTARGVELLGRNSLRGLQRGWEALKYLGSLVQYWGLELKKSTISLVDTIAIAVAEGT
DRIINIVQGICRAIHNIPRRIRQGFEAALQ$

Fig. 57B

2003 CON_06_CPX Env.seq.opt

ATGCGCGTGAAGGGCATCCAGAAGAACTGGCAGCACCTGTGGAAGTGGGGCACCCTGATCCTGGGCCTGGTGATCATCTGCTCCGCCTCCAA
CAACATGTGGGTGACCGTGTACTACGGCGTGCCCGCCTGGGAGGACGCCGACACCATCCTGTTCTGCGCCTCCGACGCCAAGGCCTACTCCG
CCGAGAAGCACAACGTGTGGGCCACCCACGCCTGCGTGCCCACCGACCCCAACCCCCAGGAGATCGCCCTGGAGAACGTGACCGAGAACTTC
AACATGTGGAAGAACCACATGGTGGAGCAGATGCACGAGGACATCATCTCCCTGTGGGACGAGTCCCTGAAGCCCTGCGTGAAGCTGACCCC
CCTGTGCGTGACCCTGAACTGCACCAACGTGACCAAGAACAACAACACCAAGATCATGGGCCGCGAGGAGATCAAGAACTGCTCCTTCAACG
TGACCACCGAGATCCGCGACAAGAAGAAGAAGGAGTACGCCCTGTTCTACCGCCTGGACGTGGTGCCCATCGACGACAACAACAACTCCTAC
CGCCTGATCAACTGCAACGCCTCCACCATCAAGCAGGCCTGCCCCAAGGTGTCCTTCGAGCCCATCCCCATCCACTACTGCGCCCCCGCCGG
CTTCGCCATCCTGAAGTGCCGCGACAAGAACTTCAACGGCACCGGCCCCTGCAAGAACGTGTCCACCGTGCAGTGCACCCACGGCATCAAGC
CCGTGGTGTCCACCCAGCTGCTGCTGAACGGCTCCCTGGCCGAGGAGGAGATCATCATCAAGTCCGAGAACCTGACCGACAACACCAAGACC
ATCATCGTGCAGCTGAACAAGTCCGTGGAGATCCGCTGCACCCGCCCCAACAACAACACCCGCAAGTCCATCTCCTTCGGCCCCGGCCAGGC
CTTCTACGCCACCGGCGACATCATCGGCGACATCCGCCAGGCCCACTGCAACGTGTCCCGCACCGACTGGAACAACATGCTGCAGAACGTGA
CCGCCAAGCTGAAGGAGCTGTTCAACAAGAACATCACCTTCAACTCCTCCGCCGGCGGCGACCTGGAGATCACCACCCACTCCTTCAACTGC
GGCGGCGAGTTCTTCTACTGCAACACCTCCCAGCTGTTCAACTCCACCCGCCCCAACGAGACCAACACCATCACCCTGCCCTGCAAGATCAA
GCAGATCGTGCGCATGTGGCAGCGCGTGGGCCAGGCCATGTACGCCCCCCCCATCGCCGGCAACATCACCTGCACCTCCAACATCACCGGCC
TGCTGCTGACCCGCGACGGCAACAACAACGACTCCGAGACCTTCCGCCCCGGCGGCGGCGACATGCGCGACAACTGGCGCTCCGAGCTGTAC
AAGTACAAGGTGGTGAAGATCAAGCCCCTGGGCATCGCCCCCACCCGCGCCCGCCGCCGCGTGGTGGGCCGCGAGAAGCGCGCCGTGGGCCT
GGGCGCCGTGTTCCTGGGCTTCCTGGGCACCGCCGGCTCCACCATGGGCGCCGCCTCCATCACCCTGACCGTGCAGGTGCGCCAGCTGCTGT
CCGGCATCGTGCAGCAGCAGTCCAACCTGCTGCGCGCCATCGAGGCCCAGCAGCACCTGCTGCAGCTGACCGTGTGGGGCATCAAGCAGCTG
CAGGCCCGCGTGCTGGCCGTGGAGCGCTACCTGAAGGACCAGCAGCTGCTGGGCATCTGGGGCTGCTCCGGCAAGCTGATCTGCCCCACCAA
CGTGCCCTGGAACGCCTCCTGGTCCAACAAGACCTACAACGAGATCTGGGACAACATGACCTGGATCGAGTGGGACCGCGAGATCAACAACT
ACACCCAGCAGATCTACTCCCTGATCGAGGAGTCCCAGAACCAGCAGGAGAAGAACGAGCAGGACCTGCTGGCCCTGGACAAGTGGGCCTCC
CTGTGGTCCTGGTTCGACATCTCCAACTGGCTGTGGTACATCAAGATCTTCATCATGATCGTGGGCGGCCTGATCGGCCTGCGCATCGTGTT
CGCCGTGCTGTCCATCGTGAACCGCGTGCGCCAGGGCTACTCCCCCCTGTCCCTGCAGACCCTGATCCCCAACCCCACCGGCGCCGACCGCC
CCGGCGAGATCGAGGAGGGCGGCGGCGAGCAGGGCCGCACCCGCTCCATCCGCCTGGTGAACGGCTTCCTGGCCCTGGCCTGGGACGACCTG
CGCTCCCTGTGCCTGTTCTCCTACCACCGCCTGCGCGACTTCGTGCTGATCGCCGCCCGCACCGTGGAGACCCTGGGCCACCGCGGCTGGGA
GATCCTGAAGTACCTGGGCAACCTGGTGTGCTACTGGGGCCAGGAGCTGAAGAACTCCGCCATCTCCCTGCTGGACACCACCGCCATCGCCG
TGGCCAACTGGACCGACCGCGTGATCGAGGTGGTGCAGCGCGTGTTCCGCGCCTTCCTGAACATCCCCCGCCGCATCCGCCAGGGCTTCGAG
CGCGCCCTGCTGTAA

Fig. 58B

2003 CON_08_BC Env seq.opt

ATGCGCGTGCGCGGCACCCGCCGCAACTACCAGCAGTGGTGGATCTGGGGCGTGCTGGGCTTCTGGATGCTGATGATCTGCAACGTGGAGGG
CAACCTGTGGGTGACCGTGTACTACGGCGTGCCCGTGTGGAAGGAGGCCAAGACCACCCTGTTCTGCGCCTCCGACGCCAAGGCCTACGAGA
CCGAGGTGCACAACGTGTGGGCCACCCACGCCTGCGTGCCCACCGACCCCAACCCCCAGGAGATCGTGATGGAGAACGTGACCGAGAACTTC
AACATGTGGAACAACGACATGGTGAACCAGATGCACGAGGACGTGATCTCCCTGTGGGACCAGTCCCTGAAGCCCTGCGTGAAGCTGACCCC
CCTGTGCGTGACCCTGGAGTGCACCAACGTGTCCTCCAACGGCAACGGCACCTACAACGAGACCTACAACGAGTCCGTGAAGGAGATCAAGA
ACTGCTCCTTCAACGCCACCACCCTGCTGCGCGACCGCAAGAAGACCGTGTACGCCCTGTTCTACCGCCTGGACATCGTGCCCCTGAACGAC
GAGAACTCCGGCAAGAACTCCTCCGAGTACTACCGCCTGATCAACTGCAACACCTCCGCCATCACCCAGGCCTGCCCCAAGGTGACCTTCGA
CCCCATCCCCATCCACTACTGCACCCCCGCCGGCTACGCCATCCTGAAGTGCAACGACAAGAAGTTCAACGGCACCGGCCAGTGCCACAACG
TGTCCACCGTGCAGTGCACCCACGGCATCAAGCCCGTGGTGTCCACCCAGCTGCTGCTGAACGGCTCCCTGGCCGAGCGCGAGATCATCATC
CGCTCCGAGAACCTGACCAACAACGTGAAGACCATCATCGTGCACCTGAACCAGTCCGTGGAGATCGTGTGCACCCGCCCCAACAACAACAC
CCGCAAGTCCATCCGCATCGGCCCCGGCCAGACCTTCTACGCCACCGGCGACATCATCGGCGACATCCGCCAGGCCCACTGCAACATCTCCA
AGGACAAGTGGTACGAGACCCTGCAGCGCGTGTCCAAGAAGCTGGCCGAGCACTTCCCCAACAAGACCATCAAGTTCGCCTCCTCCTCCGGC
GGCGACCTGGAGATCACCACCCACTCCTTCAACTGCCGCGGCGAGTTCTTCTACTGCAACACCTCCGGCCTGTTCAACGGCACCTACATGAA
CGGCACCAACAACTCCTCCTCCATCATCACCATCCCCTGCCGCATCAAGCAGATCATCAACATGTGGCAGGAGGTGGGCCGCGCCATGTACG
CCCCCCCCATCGAGGGCAACATCACCTGCAAGTCCAACATCACCGGCCTGCTGCTGGTGCGCGACGGCGGCCGCACCGAGTCCAACAACACC
GAGATCTTCCGCCCCGGCGGCGGCGACATGCGCAACAACTGGCGCAACGAGCTGTACAAGTACAAGGTGGTGGAGATCAAGCCCCTGGGCGT
GGCCCCCACCGCCGCCAAGCGCCGCGTGGTGGAGCGCGAGAAGCGCGCCGTGGGCCTGGGCGCCGTGTTCCTGGGCTTCCTGGGCGCCGCCG
GCTCCACCATGGGCGCCGCCTCCATCACCCTGACCGTGCAGGCCCGCCAGCTGCTGTCCGGCATCGTGCAGCAGCAGTCCAACCTGCTGCGC
GCCATCGAGGCCCAGCAGCACATGCTGCAGCTGACCGTGTGGGGCATCAAGCAGCTGCAGACCCGCGTGCTGGCCATCGAGCGCTACCTGAA
GGACCAGCAGCTGCTGGGCATCTGGGGCTGCTCCGGCAAGCTGATCTGCACCACCGCCGTGCCCTGGAACTCCTCCTGGTCCAACAAGTCCC
AGCAGGAGATCTGGGACAACATGACCTGGATGCAGTGGGACAAGGAGATCTCCAACTACACCAACACCATCTACCGCCTGCTGGAGGACTCC
CAGAACCAGCAGGAGCGCAACGAGAAGGACCTGCTGGCCCTGGACTCCTGGAAGAACCTGTGGTCCTGGTTCGACATCACCAACTGGCTGTG
GTACATCAAGATCTTCATCATGATCGTGGGCGGCCTGATCGGCCTGCGCATCATCTTCGCCGTGCTGTCCATCGTGAACCGCGTGCGCCAGG
GCTACTCCCCCCTGTCCTTCCAGATCCTGACCCCCAACCCCGGCGGCCCCGGCCGCCTGGGCCGCATCGAGGAGGAGGGCGGCGAGCAGGAC
AAGACCCGCTCCATCCGCCTGGTGAACGGCTTCCTGGCCCTGGCCTGGGACGACCTGCGCAACCTGTGCCTGTTCTCCTACCACCGCCTGCG
CGACTTCATCCTGCTGACCGCCCGCGGCGTGGAGCTGCTGGGCCGCAACTCCCTGCGCGGCCTGCAGCGCGGCTGGGAGGCCCTGAAGTACC
TGGGCTCCCTGGTGCAGTACTGGGGCCTGGAGCTGAAGAAGTCCACCATCTCCCTGGTGGACACCATCGCCATCGCCGTGGCCGAGGGCACC
GACCGCATCATCAACATCGTGCAGGGCATCTGCCGCGCCATCCACAACATCCCCCGCCGCATCCGCCAGGGCTTCGAGGCCGCCCTGCAGTA
A

Fig. 59A

2003 CON_10_CD Env

MRVMGIQRNCQQWWIWGILGFWMLMICNATGNLWVTVYYGVPVWKETTTTLFCASDAKAYKAEAHNIWATHACVPTDPNPQEIVLENVTENF
NMWKNGMVDQMHEDIISLWDQGLKPCVKLTPLCVTLNCSDVNATNSATNTVVAGMKNCSFNITTEIRDKKKQEYALFYKLDVVQIDGSNTSY
RLINCNTSAITQACPKVTFEPIPIHYCAPAGFAILKCNDKKFNGTGPCKNVSTVQCTHGIKPVVSTQLLLNGSLAEEEIIIRSENLTDNAKT
IIVQLNESVTINCTRPNNNTRKSIRIGPGQTFYATGDIIGNIRQAYCNISGTEWNKTLQQVAKKLGDLLNKTTIIFKPSSGGDPEITTHTFN
CGGEFFYCNTSKLFNSSWTSNNTGNTSTITLPCRIKQIINMWQGVGKAIYAPPIAGLINCSSNITGLLLTRDGGANNSETFRPGGGDMRDNW
RSELYKYKVVKIEPLGLAPTKAKRRVVEREKRAIGLGAVFLGFLGAAGSTMGAASLTLTVQARQLLSGIVQQQNNLLRAIEAQQHLLQLTVW
GIKQLQARVLAVESYLKDQQLLGIWGCSGKHICTTNVPWNSSWSNKSLEEIWDNMTWMEWEREIDNYTGLIYSLIEESQNQQEKNEQELLQL
DKWASLWNWFSITNWLWYIKIFIMIVGGLIGLRIVFAVLSLVNRVRQGYSPLSFQTLLPAPRGPDRPEGIEEEGGEQGRGRSIRLVNGFSAL
IWDDLRNLCLFSYHRLRDLILIATRIVELLGRRGWEAIKYLWNLLQYWIQELKNSAISLLDTTAIAVAEGTDRAIEIVQRAVRAVLNIPTRI
RQGLERALL$

Fig. 60A

2003 CON_11_CPX Env

MRVKETQRNWHNLWRWGLMIFGMLMICNATENLWVTVYYGVPVWKDADTTLFCASDAKAYSTEKHNVWATHACVPTDPNPQEIPLENVTENF
NMWKNNMVEQMHEDIISLWDESLKPCVKLTPLCVTLNCTDVKNATNTTVEAAEIKNCSFNITTEIKDKKKEYALFYKLDVVPINDNNNSIY
RLINCNVSTVKQACPKVTFEPIPIHYCAPAGFAILKCNDKKFNGTGPCKNVSTVQCTHGIKPVVSTQLLLNGSLAEGEVRIRSENFTNNAKT
IIVQLNSSVRINCTRPNNNTRKSIHIGPGQAFYATGDIIGDIRQAHCNISRAEWNNTLQQVAKQLRENFNKTIIFNNPSGGDLEITTHSFNC
GGEFFYCNTSRLFNSTWNNDTRNDTKQMHITLPCRIKQIVNMWQRVGQAMYAPPIQGKIRCNSNITGLLLTRDGGNNNTNETFRPTGGDMRD
NWRSELYKYKVVEIKPLGVAPTRAKRRVVEREKRAVGIGAVLLGFLGAAGSTMGAASITLTVQARQLLSGIVQQQSNLLKAIEAQQHLLKLT
VWGIKQLQARVLAVERYLKDQQLLGIWGCSGKLICTTNVPWNFSWSNKSYDEIWDNMTWIEWEREINNYTQTIYTLLEESQNQQEKNEQDLL
ALDKWASLWNWFDISNWLWYIKIFIMIVGGLIGLRIIFAVLSIVNRCRQGYSPLSFQTLTPNHKEADRPGGIEEGGGEQDRTRSIRLVSGFL
ALAWDDLRNLCLFSYHRLRDFILIAARIVETLGRRGWEILKYLGNLAQYWGQELKNSAISLLNATAIAVAEGTDRIIEVVHRVLRAILHIPR
RIRQGFERALL$

Fig. 59B

2003 CON_10_CD Env.seq.opt

ATGCGCGTGATGGGCATCCAGCGCAACTGCCAGCAGTGGTGGATCTGGGGCATCCTGGGCTTCTGGATGCTGATGATCTGCAACGCCACCGG
CAACCTGTGGGTGACCGTGTACTACGGCGTGCCCGTGTGGAAGGAGACCACCACCACCCTGTTCTGCGCCTCCGACGCCAAGGCCTACAAGG
CCGAGGCCCACAACATCTGGGCCACCCACGCCTGCGTGCCCACCGACCCCAACCCCCAGGAGATCGTGCTGGAGAACGTGACCGAGAACTTC
AACATGTGGAAGAACGGCATGGTGGACCAGATGCACGAGGACATCATCTCCCTGTGGGACCAGGGCCTGAAGCCCTGCGTGAAGCTGACCCC
CCTGTGCGTGACCCTGAACTGCTCCGACGTGAACGCCACCAACTCCGCCACCAACACCGTGGTGGCCGGCATGAAGAACTGCTCCTTCAACA
TCACCACCGAGATCCGCGACAAGAAGAAGCAGGAGTACGCCCTGTTCTACAAGCTGGACGTGGTGCAGATCGACGGCTCCAACACCTCCTAC
CGCCTGATCAACTGCAACACCTCCGCCATCACCCAGGCCTGCCCCAAGGTGACCTTCGAGCCCATCCCCATCCACTACTGCGCCCCCGCCGG
CTTCGCCATCCTGAAGTGCAACGACAAGAAGTTCAACGGCACCGGCCCCTGCAAGAACGTGTCCACCGTGCAGTGCACCCACGGCATCAAGC
CCGTGGTGTCCACCCAGCTGCTGCTGAACGGCTCCCTGGCCGAGGAGGAGATCATCATCCGCTCCGAGAACCTGACCGACAACGCCAAGACC
ATCATCGTGCAGCTGAACGAGTCCGTGACCATCAACTGCACCCGCCCCAACAACAACACCCGCAAGTCCATCCGCATCGGCCCCGGCCAGAC
CTTCTACGCCACCGGCGACATCATCGGCAACATCCGCCAGGCCTACTGCAACATCTCCGGCACCGAGTGGAACAAGACCCTGCAGCAGGTGG
CCAAGAAGCTGGGCGACCTGCTGAACAAGACCACCATCATCTTCAAGCCCTCCTCCGGCGGCGACCCCGAGATCACCACCCACACCTTCAAC
TGCGGCGGCGAGTTCTTCTACTGCAACACCTCCAAGCTGTTCAACTCCTCCTGGACCTCCAACAACACCGGCAACACCTCCACCATCACCCT
GCCCTGCCGCATCAAGCAGATCATCAACATGTGGCAGGGCGTGGGCAAGGCCATCTACGCCCCCCCCATCGCCGGCCTGATCAACTGCTCCT
CCAACATCACCGGCCTGCTGCTGACCCGCGACGGCGGCGCCAACAACTCCGAGACCTTCCGCCCCGGCGGCGGCGACATGCGCGACAACTGG
CGCTCCGAGCTGTACAAGTACAAGGTGGTGAAGATCGAGCCCCTGGGCCTGGCCCCCACCAAGGCCAAGCGCCGCGTGGTGGAGCGCGAGAA
GCGCGCCATCGGCCTGGGCGCCGTGTTCCTGGGCTTCCTGGGCGCCGCCGGCTCCACCATGGGCGCCGCCTCCCTGACCCTGACCGTGCAGG
CCCGCCAGCTGCTGTCCGGCATCGTGCAGCAGCAGAACAACCTGCTGCGCGCCATCGAGGCCCAGCAGCACCTGCTGCAGCTGACCGTGTGG
GGCATCAAGCAGCTGCAGGCCCGCGTGCTGGCCGTGGAGTCCTACCTGAAGGACCAGCAGCTGCTGGGCATCTGGGGCTGCTCCGGCAAGCA
CATCTGCACCACCAACGTGCCCTGGAACTCCTCCTGGTCCAACAAGTCCCTGGAGGAGATCTGGGACAACATGACCTGGATGGAGTGGGAGC
GCGAGATCGACAACTACACCGGCCTGATCTACTCCCTGATCGAGGAGTCCCAGAACCAGCAGGAGAAGAACGAGCAGGAGCTGCTGCAGCTG
GACAAGTGGGCCTCCCTGTGGAACTGGTTCTCCATCACCAACTGGCTGTGGTACATCAAGATCTTCATCATGATCGTGGGCGGCCTGATCGG
CCTGCGCATCGTGTTCGCCGTGCTGTCCCTGGTGAACCGCGTGCGCCAGGGCTACTCCCCCCTGTCCTTCCAGACCCTGCTGCCCGCCCCCC
GCGGCCCCGACCGCCCCGAGGGCATCGAGGAGGAGGGCGGCGAGCAGGGCCGCGGCCGCTCCATCCGCCTGGTGAACGGCTTCTCCGCCCTG
ATCTGGGACGACCTGCGCAACCTGTGCCTGTTCTCCTACCACCGCCTGCGCGACCTGATCCTGATCGCCACCCGCATCGTGGAGCTGCTGGG
CCGCCGCGGCTGGGAGGCCATCAAGTACCTGTGGAACCTGCTGCAGTACTGGATCCAGGAGCTGAAGAACTCCGCCATCTCCCTGCTGGACA
CCACCGCCATCGCCGTGGCCGAGGGCACCGACCGCGCCATCGAGATCGTGCAGCGCGCCGTGCGCGCCGTGCTGAACATCCCCACCCGCATC
CGCCAGGGCCTGGAGCGCGCCCTGCTGTAA

Fig. 60B

2003 CON_11_CPX Env.seq.opt

ATGCGCGTGAAGGAGACCCAGCGCAACTGGCACAACCTGTGGCGCTGGGGCCTGATGATCTTCGGCATGCTGATGATCTGCAACGCCACCGA
GAACCTGTGGGTGACCGTGTACTACGGCGTGCCCGTGTGGAAGGACGCCGACACCACCCTGTTCTGCGCCTCCGACGCCAAGGCCTACTCCA
CCGAGAAGCACAACGTGTGGGCCACCCACGCCTGCGTGCCCACCGACCCCAACCCCCAGGAGATCCCCCTGGAGAACGTGACCGAGAACTTC
AACATGTGGAAGAACAACATGGTGGAGCAGATGCACGAGGACATCATCTCCCTGTGGGACGAGTCCCTGAAGCCCTGCGTGAAGCTGACCCC
CCTGTGCGTGACCCTGAACTGCACCGACGTGAAGAACGCCACCAACACCACCGTGGAGGCCGCCGAGATCAAGAACTGCTCCTTCAACATCA
CCACCGAGATCAAGGACAAGAAGAAGAAGGAGTACGCCCTGTTCTACAAGCTGGACGTGGTGCCCATCAACGACAACAACAACTCCATCTAC
CGCCTGATCAACTGCAACGTGTCCACCGTGAAGCAGGCCTGCCCCAAGGTGACCTTCGAGCCCATCCCCATCCACTACTGCGCCCCCGCCGG
CTTCGCCATCCTGAAGTGCAACGACAAGAAGTTCAACGGCACCGGCCCCTGCAAGAACGTGTCCACCGTGCAGTGCACCCACGGCATCAAGC
CCGTGGTGTCCACCCAGCTGCTGCTGAACGGCTCCCTGGCCGAGGGCGAGGTGCGCATCCGCTCCGAGAACTTCACCAACAACGCCAAGACC
ATCATCGTGCAGCTGAACTCCTCCGTGCGCATCAACTGCACCCGCCCCAACAACAACACCCGCAAGTCCATCCACATCGGCCCCGGCCAGGC
CTTCTACGCCACCGGCGACATCATCGGCGACATCCGCCAGGCCCACTGCAACATCTCCCGCGCCGAGTGGAACAACACCCTGCAGCAGGTGG
CCAAGCAGCTGCGCGAGAACTTCAACAAGACCATCATCTTCAACAACCCCTCCGGCGGCGACCTGGAGATCACCACCCACTCCTTCAACTGC
GGCGGCGAGTTCTTCTACTGCAACACCTCCCGCCTGTTCAACTCCACCTGGAACAACGACACCCGCAACGACACCAAGCAGATGCACATCAC
CCTGCCCTGCCGCATCAAGCAGATCGTGAACATGTGGCAGCGCGTGGGCCAGGCCATGTACGCCCCCCCCATCCAGGGCAAGATCCGCTGCA
ACTCCAACATCACCGGCCTGCTGCTGACCCGCGACGGCGGCAACAACAACACCAACGAGACCTTCCGCCCCACCGGCGGCGACATGCGCGAC
AACTGGCGCTCCGAGCTGTACAAGTACAAGGTGGTGGAGATCAAGCCCCTGGGCGTGGCCCCCACCCGCGCCAAGCGCCGCGTGGTGGAGCG
CGAGAAGCGCGCCGTGGGCATCGGCGCCGTGCTGCTGGGCTTCCTGGGCGCCGCCGGCTCCACCATGGGCGCCGCCTCCATCACCCTGACCG
TGCAGGCCCGCCAGCTGCTGTCCGGCATCGTGCAGCAGCAGTCCAACCTGCTGAAGGCCATCGAGGCCCAGCAGCACCTGCTGAAGCTGACC
GTGTGGGGCATCAAGCAGCTGCAGGCCCGCGTGCTGGCCGTGGAGCGCTACCTGAAGGACCAGCAGCTGCTGGGCATCTGGGGCTGCTCCGG
CAAGCTGATCTGCACCACCAACGTGCCCTGGAACTTCTCCTGGTCCAACAAGTCCTACGACGAGATCTGGGACAACATGACCTGGATCGAGT
GGGAGCGCGAGATCAACAACTACACCCAGACCATCTACACCCTGCTGGAGGAGTCCCAGAACCAGCAGGAGAAGAACGAGCAGGACCTGCTG
GCCCTGGACAAGTGGGCCTCCCTGTGGAACTGGTTCGACATCTCCAACTGGCTGTGGTACATCAAGATCTTCATCATGATCGTGGGCGGCCT
GATCGGCCTGCGCATCATCTTCGCCGTGCTGTCCATCGTGAACCGCTGCCGCCAGGGCTACTCCCCCCTGTCCTTCCAGACCCTGACCCCCA
ACCACAAGGAGGCCGACCGCCCCGGCGGCATCGAGGAGGGCGGCGGCGAGCAGGACCGCACCCGCTCCATCCGCCTGGTGTCCGGCTTCCTG
GCCCTGGCCTGGGACGACCTGCGCAACCTGTGCCTGTTCTCCTACCACCGCCTGCGCGACTTCATCCTGATCGCCGCCCGCATCGTGGAGAC
CCTGGGCCGCCGCGGCTGGGAGATCCTGAAGTACCTGGGCAACCTGGCCCAGTACTGGGGCCAGGAGCTGAAGAACTCCGCCATCTCCCTGC
TGAACGCCACCGCCATCGCCGTGGCCGAGGGCACCGACCGCATCATCGAGGTGGTGCACCGCGTGCTGCGCGCCATCCTGCACATCCCCCGC
CGCATCCGCCAGGGCTTCGAGCGCGCCCTGCTGTAA

Fig. 61A

2003 CON_12_BF Env

```
MRVRGMQRNWQHLGKWGLLFLGILIICNATENLWVTVYYGVPVWKEATTTLFCASDAKSYEREVHNVWATHACVPTDPNPQEVDLENVTENF
DMWKNNMVEQMHTDIISLWDQSLKPCVKLTPLCVTLNCTDANATANATKEHPEGRAGAIQNCSFNMTTEVRDKQMKVQALFYRLDIVPISDN
NSNEYRLINCNTSTITQACPKVSWDPIPIHYCAPAGYAILKCNDKKFNGTGPCKNVSTVQCTHGIKPVVSTQLLLNGSLAEEEIIIRSQNIS
DNAKTIIVHLNESVQINCTRPNNNTRKSIHIGPGRAFYATGDIIGDIRKAHCNVSGTQWNKTLEQVKKKLRSYFNTTIKFNSSSGGDPEITM
HSFNCRGEFFYCNTSKLFNDTVSNDTIILPCRIKQIVNMWQEVGRAMYAAPIAGNITCTSNITGLLLTRDGGHNETNKTETFRPGGGNMKDN
WRSELYKYKVVEIEPLGVAPTRAKRQVVKREKRAVGIGALFLGFLGAAGSTMGAASITLTVQARQLLSGIVQQQSNLLRAIEAQQHLLQLTV
WGIKQLQARVLAVERYLKDQQLLGLWGCSGKLICTTNVPWNSSWSNKSQEEIWENMTWMEWEKEINNYSNEIYRLIEESQNQQEKNEQELLA
LDKWASLWNWFDISNWLWYIRIFIMIVGGLIGLRIVFAVLSIVNRVRKGYSPLSLQTHIPSPREPDRPEGIEEGGGEQGKDRSVRLVNGFLA
LIWDDLRSLCLFSYHRLRDLLLIVTRIVELLGRRGWEVLKYWWNLLQYWSQELKNSAISLLNTTAIVVAEGTDRVIEALQRVGRAILNIPRR
IRQGLERALL$
```

Fig. 62A

2003 CON_14_BG Env

```
MKAKGTQRNWQSLWKWGTLILGLVIICSASNDLWVTVYYGVPVWKEATTTLFCASDAKAYDAEVHNVWATHACVPTDPNPQEVALENVTENF
NMWENNMVDQMQEDIISLWDQSLKPCVELTPLCVTLNCTDFNNTTNNTTNTRNDGEGEIKNCSFNITTSLRDKIKKEYALFYNLDVVQMDND
NSSYRLTSCNTSIITQACPKVSFTPIPIHYCAPAGFVILKCNNKTFNGTGPCTNVSTVQCTHGIRPVVSTQLLLNGSLAEEEIVIRSKNFTD
NAKTIIVQLKDPIEINCTRPNNNTRKRITMGPGRVLYTTGQIIGDIRKAHCNISKTKWNNTLGQIVKKLREQFMNKTIVFQRSSGGDPEIVM
HSFNCGGEFFYCNTTQLFNSTWRSNSTWNDTTETNNTDLITLPCRIKQIVNMWQKVGKAMYAPPISGQIRCSSNITGLLLIRDGGSNNTETF
RPGGGNMKDNWRSELYKYKVVKIEPLGVAPTRAKRRVVQREKRAVGIGALLFGFLGAAGSTMGAASMTLTVQARQLLSGIVQQQNNLLRAIE
AQQHMLQLTVWGIKQLQARVLAVERYLKDQQLLGIWGCSGKLICTTTVPWNASWSNKSLDDIWNNMTWMEWEREIDNYTGLIYTLIEQSQNQ
QERNEQELLELDKWASLWNWFNITNWLWYIKIFIMIIGGLIGLRIVFAVLSIINRVRKGYSPLSFQTLTHHQREPDRPGRIEEEGGEQDKDR
SIRLVSGFLALAWDDLRSLCLFSYHRLRDFILIAARTVELLGRSSLKGLRLGWEGLKYLWNLLLYWGRELKNSAINLLDTVAIAVANWTDRA
IEVVQRVGRAVLNIPVRIRQGLERALL$
```

Fig. 61B

2003 CON_12_BF Env.seq.opt

ATGCGCGTGCGCGGCATGCAGCGCAACTGGCAGCACCTGGGCAAGTGGGGCCTGCTGTTCCTGGGCATCCTGATCATCTGCAACGCCACCGA
GAACCTGTGGGTGACCGTGTACTACGGCGTGCCCGTGTGGAAGGAGGCCACCACCACCCTGTTCTGCGCCTCCGACGCCAAGTCCTACGAGC
GCGAGGTGCACAACGTGTGGGCCACCCACGCCTGCGTGCCCACCGACCCCAACCCCCAGGAGGTGGACCTGGAGAACGTGACCGAGAACTTC
GACATGTGGAAGAACAACATGGTGGAGCAGATGCACACCGACATCATCTCCCTGTGGGACCAGTCCCTGAAGCCCTGCGTGAAGCTGACCCC
CCTGTGCGTGACCCTGAACTGCACCGACGCCAACGCCACCGCCAACGCCACCAAGGAGCACCCCGAGGGCCGCGCCGGCGCCATCCAGAACT
GCTCCTTCAACATGACCACCGAGGTGCGCGACAAGCAGATGAAGGTGCAGGCCCTGTTCTACCGCCTGGACATCGTGCCCATCTCCGACAAC
AACTCCAACGAGTACCGCCTGATCAACTGCAACACCTCCACCATCACCCAGGCCTGCCCCAAGGTGTCCTGGACCCCCATCCCCATCCACTA
CTGCGCCCCCGCCGGCTACGCCATCCTGAAGTGCAACGACAAGAAGTTCAACGGCACCGGCCCCTGCAAGAACGTGTCCACCGTGCAGTGCA
CCCACGGCATCAAGCCCGTGGTGTCCACCCAGCTGCTGCTGAACGGCTCCCTGGCCGAGGAGGAGATCATCATCCGCTCCCAGAACATCTCC
GACAACGCCAAGACCATCATCGTGCACCTGAACGAGTCCGTGCAGATCAACTGCACCCGCCCCAACAACAACACCCGCAAGTCCATCCACAT
CGGCCCCGGCCGCGCCTTCTACGCCACCGGCGACATCATCGGCGACATCCGCAAGGCCCACTGCAACGTGTCCGGCACCCAGTGGAACAAGA
CCCTGGAGCAGGTGAAGAAGAAGCTGCGCTCCTACTTCAACACCACCATCAAGTTCAACTCCTCCTCCGGCGGCGACCCCGAGATCACCATG
CACTCCTTCAACTGCCGCGGCGAGTTCTTCTACTGCAACACCTCCAAGCTGTTCAACGACACCGTGTCCAACGACACCATCATCCTGCCCTG
CCGCATCAAGCAGATCGTGAACATGTGGCAGGAGGTGGGCCGCGCCATGTACGCCGCCCCCATCGCCGGCAACATCACCTGCACCTCCAACA
TCACCGGCCTGCTGCTGACCCGCGACGGCGGCCACAACGAGACCAACAAGACCGAGACCTTCCGCCCCGGCGGCGGCAACATGAAGGACAAC
TGGCGCTCCGAGCTGTACAAGTACAAGGTGGTGGAGATCGAGCCCCTGGGCGTGGCCCCCACCCGCGCCAAGCGCCAGGTGGTGAAGCGCGA
GAAGCGCGCCGTGGGCATCGGCGCCCTGTTCCTGGGCTTCCTGGGCGCCGCCGGCTCCACCATGGGCGCCGCCTCCATCACCCTGACCGTGC
AGGCCCGCCAGCTGCTGTCCGGCATCGTGCAGCAGCAGTCCAACCTGCTGCGCGCCATCGAGGCCCAGCAGCACCTGCTGCAGCTGACCGTG
TGGGGCATCAAGCAGCTGCAGGCCCGCGTGCTGGCCGTGGAGCGCTACCTGAAGGACCAGCAGCTGCTGGGCCTGTGGGGCTGCTCCGGCAA
GCTGATCTGCACCACCAACGTGCCCTGGAACTCCTCCTGGTCCAACAAGTCCCAGGAGGAGATCTGGGAGAACATGACCTGGATGGAGTGGG
AGAAGGAGATCAACAACTACTCCAACGAGATCTACCGCCTGATCGAGGAGTCCCAGAACCAGCAGGAGAAGAACGAGCAGGAGCTGCTGGCC
CTGGACAAGTGGGCCTCCCTGTGGAACTGGTTCGACATCTCCAACTGGCTGTGGTACATCCGCATCTTCATCATGATCGTGGGCGGCCTGAT
CGGCCTGCGCATCGTGTTCGCCGTGCTGTCCATCGTGAACCGCGTGCGCAAGGGCTACTCCCCCCTGTCCCTGCAGACCCACATCCCCTCCC
CCCGCGAGCCCGACCGCCCCGAGGGCATCGAGGAGGGCGGCGGCGAGCAGGGCAAGGACCGCTCCGTGCGCCTGGTGAACGGCTTCCTGGCC
CTGATCTGGGACGACCTGCGCTCCCTGTGCCTGTTCTCCTACCACCGCCTGCGCGACCTGCTGCTGATCGTGACCCGCATCGTGGAGCTGCT
GGGCCGCCGCGGCTGGGAGGTGCTGAAGTACTGGTGGAACCTGCTGCAGTACTGGTCCCAGGAGCTGAAGAACTCCGCCATCTCCCTGCTGA
ACACCACCGCCATCGTGGTGGCCGAGGGCACCGACCGCGTGATCGAGGCCCTGCAGCGCGTGGGCCGCGCCATCCTGAACATCCCCCGCCGC
ATCCGCCAGGGCCTGGAGCGCGCCCTGCTGTAA

*Fig. 62B*

2003 CON_14_BG Env.seq.opt

ATGAAGGCCAAGGGCACCCAGCGCAACTGGCAGTCCCTGTGGAAGTGGGGCACCCTGATCCTGGGCCTGGTGATCATCTGCTCCGCCTCCAA
CGACCTGTGGGTGACCGTGTACTACGGCGTGCCCGTGTGGAAGGAGGCCACCACCACCCTGTTCTGCGCCTCCGACGCCAAGGCCTACGACG
CCGAGGTGCACAACGTGTGGGCCACCCACGCCTGCGTGCCCACCGACCCCAACCCCCAGGAGGTGGCCCTGGAGAACGTGACCGAGAACTTC
AACATGTGGGAGAACAACATGGTGGACCAGATGCAGGAGGACATCATCTCCCTGTGGGACCAGTCCCTGAAGCCCTGCGTGGAGCTGACCCC
CCTGTGCGTGACCCTGAACTGCACCGACTTCAACAACACCACCAACAACACCACCAACACCCGCAACGACGGCGAGGGCGAGATCAAGAACT
GCTCCTTCAACATCACCACCTCCCTGCGCGACAAGATCAAGAAGGAGTACGCCCTGTTCTACAACCTGGACGTGGTGCAGATGGACAACGAC
AACTCCTCCTACCGCCTGACCTCCTGCAACACCTCCATCATCACCCAGGCCTGCCCCAAGGTGTCCTTCACCCCCATCCCCATCCACTACTG
CGCCCCCGCCGGCTTCGTGATCCTGAAGTGCAACAACAAGACCTTCAACGGCACCGGCCCCTGCACCAACGTGTCCACCGTGCAGTGCACCC
ACGGCATCCGCCCCGTGGTGTCCACCCAGCTGCTGCTGAACGGCTCCCTGGCCGAGGAGGAGATCGTGATCCGCTCCAAGAACTTCACCGAC
AACGCCAAGACCATCATCGTGCAGCTGAAGGACCCCATCGAGATCAACTGCACCCGCCCCAACAACAACACCCGCAAGCGCATCACCATGGG
CCCCGGCCGCGTGCTGTACACCACCGGCCAGATCATCGGCGACATCCGCAAGGCCCACTGCAACATCTCCAAGACCAAGTGGAACAACACCC
TGGGCCAGATCGTGAAGAAGCTGCGCGAGCAGTTCATGAACAAGACCATCGTGTTCCAGCGCTCCTCCGGCGGCGACCCCGAGATCGTGATG
CACTCCTTCAACTGCGGCGGCGAGTTCTTCTACTGCAACACCACCCAGCTGTTCAACTCCACCTGGCGCTCCAACTCCACCTGGAACGACAC
CACCGAGACCAACAACACCGACCTGATCACCCTGCCCTGCCGCATCAAGCAGATCGTGAACATGTGGCAGAAGGTGGGCAAGGCCATGTACG
CCCCCCCCATCTCCGGCCAGATCCGCTGCTCCTCCAACATCACCGGCCTGCTGCTGATCCGCGACGGCGGCTCCAACAACACCGAGACCTTC
CGCCCCGGCGGCGGCAACATGAAGGACAACTGGCGCTCCGAGCTGTACAAGTACAAGGTGGTGAAGATCGAGCCCCTGGGCGTGGCCCCCAC
CCGCGCCAAGCGCCGCGTGGTGCAGCGCGAGAAGCGCGCCGTGGGCATCGGCGCCCTGCTGTTCGGCTTCCTGGGCGCCGCCGGCTCCACCA
TGGGCGCCGCCTCCATGACCCTGACCGTGCAGGCCCGCCAGCTGCTGTCCGGCATCGTGCAGCAGCAGAACAACCTGCTGCGCGCCATCGAG
GCCCAGCAGCACATGCTGCAGCTGACCGTGTGGGGCATCAAGCAGCTGCAGGCCCGCGTGCTGGCCGTGGAGCGCTACCTGAAGGACCAGCA
GCTGCTGGGCATCTGGGGCTGCTCCGGCAAGCTGATCTGCACCACCACCGTGCCCTGGAACGCCTCCTGGTCCAACAAGTCCCTGGACGACA
TCTGGAACAACATGACCTGGATGGAGTGGGAGCGCGAGATCGACAACTACACCGGCCTGATCTACACCCTGATCGAGCAGTCCCAGAACCAG
CAGGAGCGCAACGAGCAGGAGCTGCTGGAGCTGGACAAGTGGGCCTCCCTGTGGAACTGGTTCAACATCACCAACTGGCTGTGGTACATCAA
GATCTTCATCATGATCATCGGCGGCCTGATCGGCCTGCGCATCGTGTTCGCCGTGCTGTCCATCATCAACCGCGTGCGCAAGGGCTACTCCC
CCCTGTCCTTCCAGACCCTGACCCACCACCAGCGCGAGCCCGACCGCCCCGGCCGCATCGAGGAGGAGGGCGGCGAGCAGGACAAGGACCGC
TCCATCCGCCTGGTGTCCGGCTTCCTGGCCCTGGCCTGGGACGACCTGCGCTCCCTGTGCCTGTTCTCCTACCACCGCCTGCGCGACTTCAT
CCTGATCGCCGCCCGCACCGTGGAGCTGCTGGGCCGCTCCTCCCTGAAGGGCCTGCGCCTGGGCTGGGAGGGCCTGAAGTACCTGTGGAACC
TGCTGCTGTACTGGGGCCGCGAGCTGAAGAACTCCGCCATCAACCTGCTGGACACCGTGGCCATCGCCGTGGCCAACTGGACCGACCGCGCC
ATCGAGGTGGTGCAGCGCGTGGGCCGCGCCGTGCTGAACATCCCCGTGCGCATCCGCCAGGGCCTGGAGCGCGCCCTGCTGTAA

Centralized HIV-1 gag/nef/pol Protein and the Codon-optimized Gene Sequences

Fig. 63A

1. 2003_CON_S gag.PEP

MGARASVLSGGKLDAWEKIRLRPGGKKKYRLKHLVWASRELERFALNPGLLETSEGCQQIIEQLQPALQTGSEELRSLYNTVATLYCVHQRI
EVKDTKEALDKIEEEQNKSKQKTQQAAADTGNSSKVSQNYPIVQNLQGQMVHQAISPRTLNAWVKVVEEKAFSPEVIPMFSALSEGATPQDL
NTMLNTVGGHQAAMQMLKDTINEEAAEWDRLHPVHAGPIPPGQMREPRGSDIAGTTSTLQEQIGWMTSNPPIPVGEIYKRWIILGLNKIVRM
YSPVSILDIRQGPKEPFRDYVDRFFKTLRAEQATQDVKNWMTDTLLVQNANPDCKTILKALGPGATLEEMMTACQGVGGPSHKARVLAEAMS
QVTNTTIMMQRGNFKGQKRIIKCFNCGKEGHIARNCRAPRKKGCWKCGKEGHQMKDCTERQANFLGKIWPSNKGRPGNFLQSRPEPTAPPAE
SFGFGEEITPSPKQEPKDKELYPLASLKSLFGNDPLSQ$

Fig. 63B

2003_CON_S gag.OPT

ATGGGCGCCCGCGCCTCCGTGCTGTCCGGCGGCAAGCTGGACGCCTGGGAGAAGATCCGCCTGCGCCCCGGCGGCAAGAAGAAGTACCGCCT
GAAGCACCTGGTGTGGGCCTCCCGCGAGCTGGAGCGCTTCGCCCTGAACCCCGGCCTGCTGGAGACCTCCGAGGGCTGCCAGCAGATCATCG
AGCAGCTGCAGCCCGCCCTGCAGACCGGCTCCGAGGAGCTGCGCTCCCTGTACAACACCGTGGCCACCCTGTACTGCGTGCACCAGCGCATC
GAGGTGAAGGACACCAAGGAGGCCCTGGACAAGATCGAGGAGGAGCAGAACAAGTCCAAGCAGAAGACCCAGCAGGCCGCCGCCGACACCGG
CAACTCCTCCAAGGTGTCCCAGAACTACCCCATCGTGCAGAACCTGCAGGGCCAGATGGTGCACCAGGCCATCTCCCCCCGCACCCTGAACG
CCTGGGTGAAGGTGGTGGAGGAGAAGGCCTTCTCCCCCGAGGTGATCCCCATGTTCTCCGCCCTGTCCGAGGGCGCCACCCCCCAGGACCTG
AACACCATGCTGAACACCGTGGGCGGCCACCAGGCCGCCATGCAGATGCTGAAGGACACCATCAACGAGGAGGCCGCCGAGTGGGACCGCCT
GCACCCCGTGCACGCCGGCCCCATCCCCCCCGGCCAGATGCGCGAGCCCCGCGGCTCCGACATCGCCGGCACCACCTCCACCCTGCAGGAGC
AGATCGGCTGGATGACCTCCAACCCCCCCATCCCCGTGGGCGAGATCTACAAGCGCTGGATCATCCTGGGCCTGAACAAGATCGTGCGCATG
TACTCCCCCGTGTCCATCCTGGACATCCGCCAGGGCCCCAAGGAGCCCTTCCGCGACTACGTGGACCGCTTCTTCAAGACCCTGCGCGCCGA
GCAGGCCACCCAGGACGTGAAGAACTGGATGACCGACACCCTGCTGGTGCAGAACGCCAACCCCGACTGCAAGACCATCCTGAAGGCCCTGG
GCCCCGGCGCCACCCTGGAGGAGATGATGACCGCCTGCCAGGGCGTGGGCGGCCCCTCCCACAAGGCCCGCGTGCTGGCCGAGGCCATGTCC
CAGGTGACCAACACCACCATCATGATGCAGCGCGGCAACTTCAAGGGCCAGAAGCGCATCATCAAGTGCTTCAACTGCGGCAAGGAGGGCCA
CATCGCCCGCAACTGCCGCGCCCCCCGCAAGAAGGGCTGCTGGAAGTGCGGCAAGGAGGGCCACCAGATGAAGGACTGCACCGAGCGCCAGG
CCAACTTCCTGGGCAAGATCTGGCCCTCCAACAAGGGCCGCCCCGGCAACTTCCTGCAGTCCCGCCCCGAGCCCACCGCCCCCCCCGCCGAG
TCCTTCGGCTTCGGCGAGGAGATCACCCCCTCCCCCAAGCAGGAGCCCAAGGACAAGGAGCTGTACCCCCTGGCCTCCCTGAAGTCCCTGTT
CGGCAACGACCCCCTGTCCCAGTAA

Fig. 64A

2. 2003_M.GROUP.anc gag.PEP

MGARASVLSGGKLDAWEKIRLRPGGKKKYRLKHLVWASRELERFALNPGLLETAEGCQQIMGQLQPALQTGTEELRSLYNTVATLYCVHQRI
EVKDTKEALDKIEEEQNKSQQKTQQAAADKGDSSQVSQNYPIVQNLQGQMVHQAISPRTLNAWVKVVEEKAFSPEVIPMFSALSEGATPQDL
NTMLNTVGGHQAAMQMLKDTINEEAAEWDRLHPVHAGPIPPGQMREPRGSDIAGTTSTLQEQIGWMTSNPPIPVGEIYKRWIILGLNKIVRM
YSPVSILDIRQGPKEPFRDYVDRFFKTLRAEQATQDVKNWMTDTLLVQNANPDCKTILKALGPGATLEEMMTACQGVGGPGHKARVLAEAMS
QVTNANIMMQRGNFKGPRRIVKCFNCGKEGHIARNCRAPRKKGCWKCGKEGHQMKDCTERQANFLGKIWPSNKGRPGNFLQSRPEPTAPPAE
SFGFGEEITPSPKQEPKDKELYPLASLKSLFGSDPLSQ$

Fig. 64B

2003_M.GROUP.anc gag.OPT

ATGGGCGCCCGCGCCTCCGTGCTGTCCGGCGGCAAGCTGGACGCCTGGGAGAAGATCCGCCTGCGCCCCGGCGGCAAGAAGAAGTACCGCCT
GAAGCACCTGGTGTGGGCCTCCCGCGAGCTGGAGCGCTTCGCCCTGAACCCCGGCCTGCTGGAGACCGCCGAGGGCTGCCAGCAGATCATGG
GCCAGCTGCAGCCCGCCCTGCAGACCGGCACCGAGGAGCTGCGCTCCCTGTACAACACCGTGGCCACCCTGTACTGCGTGCACCAGCGCATC
GAGGTGAAGGACACCAAGGAGGCCCTGGACAAGATCGAGGAGGAGCAGAACAAGTCCCAGCAGAAGACCCAGCAGGCCGCCGCCGACAAGGG
CGACTCCTCCCAGGTGTCCCAGAACTACCCCATCGTGCAGAACCTGCAGGGCCAGATGGTGCACCAGGCCATCTCCCCCCGCACCCTGAACG
CCTGGGTGAAGGTGGTGGAGGAGAAGGCCTTCTCCCCCGAGGTGATCCCCATGTTCTCCGCCCTGTCCGAGGGCGCCACCCCCCAGGACCTG
AACACCATGCTGAACACCGTGGGCGGCCACCAGGCCGCCATGCAGATGCTGAAGGACACCATCAACGAGGAGGCCGCCGAGTGGGACCGCCT
GCACCCCGTGCACGCCGGCCCCATCCCCCCCGGCCAGATGCGCGAGCCCCGCGGCTCCGACATCGCCGGCACCACCTCCACCCTGCAGGAGC
AGATCGGCTGGATGACCTCCAACCCCCCCATCCCCGTGGGCGAGATCTACAAGCGCTGGATCATCCTGGGCCTGAACAAGATCGTGCGCATG
TACTCCCCCGTGTCCATCCTGGACATCCGCCAGGGCCCCAAGGAGCCCTTCCGCGACTACGTGGACCGCTTCTTCAAGACCCTGCGCGCCGA
GCAGGCCACCCAGGACGTGAAGAACTGGATGACCGACACCCTGCTGGTGCAGAACGCCAACCCCGACTGCAAGACCATCCTGAAGGCCCTGG
GCCCCGGCGCCACCCTGGAGGAGATGATGACCGCCTGCCAGGGCGTGGGCGGCCCCGGCCACAAGGCCCGCGTGCTGGCCGAGGCCATGTCC
CAGGTGACCAACGCCAACATCATGATGCAGCGCGGCAACTTCAAGGGCCCCCGCCGCATCGTGAAGTGCTTCAACTGCGGCAAGGAGGGCCA
CATCGCCCGCAACTGCCGCGCCCCCCGCAAGAAGGGCTGCTGGAAGTGCGGCAAGGAGGGCCACCAGATGAAGGACTGCACCGAGCGCCAGG
CCAACTTCCTGGGCAAGATCTGGCCCTCCAACAAGGGCCGCCCCGGCAACTTCCTGCAGTCCCGCCCCGAGCCCACCGCCCCCCCCGCCGAG
TCCTTCGGCTTCGGCGAGGAGATCACCCCCTCCCCCAAGCAGGAGCCCAAGGACAAGGAGCTGTACCCCCTGGCCTCCCTGAAGTCCCTGTT
CGGCTCCGACCCCCTGTCCCAGTAA

*Fig. 65A*

3. 2003_CON_A1 gag.PEP

MGARASVLSGGKLDAWEKIRLRPGGKKKYRLKHLVWASRELERFALNPSLLETTEGCQQIMEQLQPALKTGTEELRSLYNTVATLYCVHQRI
DVKDTKEALDKIEEIQNKSKQKTQQAAADTGNSSKVSQNYPIVQNAQGQMVHQSLSPRTLNAWVKVIEEKAFSPEVIPMFSALSEGATPQDL
NMMLNIVGGHQAAMQMLKDTINEEAAEWDRLHPVHAGPIPPGQMREPRGSDIAGTTSTPQEQIGWMTGNPPIPVGDIYKRWIILGLNKIVRM
YSPVSILDIKQGPKEPFRDYVDRFFKTLRAEQATQEVKNWMTETLLVQNANPDCKSILRALGPGATLEEMMTACQGVGGPGHKARVLAEAMS
QVQHTNIMMQRGNFRGQKRIKCFNCGKEGHLARNCRAPRKKGCWKCGKEGHQMKDCTERQANFLGKIWPSSKGRPGNFPQSRPEPTAPPAEI
FGMGEEITSPPKQEQKDREQDPPLVSLKSLFGNDPLSQ$

*Fig. 65B*

3. 2003_CON_A1 gag.OPT

ATGGGCGCCCGCGCCTCCGTGCTGTCCGGCGGCAAGCTGGACGCCTGGGAGAAGATCCGCCTGCGCCCCGGCGGCAAGAAGAAGTACCGCCT
GAAGCACCTGGTGTGGGCCTCCCGCGAGCTGGAGCGCTTCGCCCTGAACCCCTCCCTGCTGGAGACCACCGAGGGCTGCCAGCAGATCATGG
AGCAGCTGCAGCCCGCCCTGAAGACCGGCACCGAGGAGCTGCGCTCCCTGTACAACACCGTGGCCACCCTGTACTGCGTGCACCAGCGCATC
GACGTGAAGGACACCAAGGAGGCCCTGGACAAGATCGAGGAGATCCAGAACAAGTCCAAGCAGAAGACCCAGCAGGCCGCCGCCGACACCGG
CAACTCCTCCAAGGTGTCCCAGAACTACCCCATCGTGCAGAACGCCCAGGGCCAGATGGTGCACCAGTCCCTGTCCCCCCGCACCCTGAACG
CCTGGGTGAAGGTGATCGAGGAGAAGGCCTTCTCCCCCGAGGTGATCCCCATGTTCTCCGCCCTGTCCGAGGGCGCCACCCCCCAGGACCTG
AACATGATGCTGAACATCGTGGGCGGCCACCAGGCCGCCATGCAGATGCTGAAGGACACCATCAACGAGGAGGCCGCCGAGTGGGACCGCCT
GCACCCCGTGCACGCCGGCCCCATCCCCCCCGGCCAGATGCGCGAGCCCCGCGGCTCCGACATCGCCGGCACCACCTCCACCCCCCAGGAGC
AGATCGGCTGGATGACCGGCAACCCCCCCATCCCCGTGGGCGACATCTACAAGCGCTGGATCATCCTGGGCCTGAACAAGATCGTGCGCATG
TACTCCCCCGTGTCCATCCTGGACATCAAGCAGGGCCCCAAGGAGCCCTTCCGCGACTACGTGGACCGCTTCTTCAAGACCCTGCGCGCCGA
GCAGGCCACCCAGGAGGTGAAGAACTGGATGACCGAGACCCTGCTGGTGCAGAACGCCAACCCCGACTGCAAGTCCATCCTGCGCGCCCTGG
GCCCCGGCGCCACCCTGGAGGAGATGATGACCGCCTGCCAGGGCGTGGGCGGCCCCGGCCACAAGGCCCGCGTGCTGGCCGAGGCCATGTCC
CAGGTGCAGCACACCAACATCATGATGCAGCGCGGCAACTTCCGCGGCCAGAAGCGCATCAAGTGCTTCAACTGCGGCAAGGAGGGCCACCT
GGCCCGCAACTGCCGCGCCCCCCGCAAGAAGGGCTGCTGGAAGTGCGGCAAGGAGGGCCACCAGATGAAGGACTGCACCGAGCGCCAGGCCA
ACTTCCTGGGCAAGATCTGGCCCTCCTCCAAGGGCCGCCCCGGCAACTTCCCCCAGTCCCGCCCCGAGCCCACCGCCCCCCCCGCCGAGATC
TTCGGCATGGGCGAGGAGATCACCTCCCCCCCCAAGCAGGAGCAGAAGGACCGCGAGCAGGACCCCCCCCTGGTGTCCCTGAAGTCCCTGTT
CGGCAACGACCCCCTGTCCCAGTAA

Fig. 65C

4. 2003_A1.anc gag.PEP

MGARASVLSGGKLDAWEKIRLRPGGKKKYRLKHLVWASRELERFALNPGLLETAEGCQQIMGQLQPALKTGTEELRSLYNTVATLYCVHQRI
EVKDTKEALDKIEEIQNKSKQKTQQAAADTGNSSKVSQNYPIVQNAQGQMVHQSLSPRTLNAWVKVIEEKAFSPEVIPMFSALSEGATPQDL
NMMLNIVGGHQAAMQMLKDTINEEAAEWDRLHPVHAGPIPPGQMREPRGSDIAGTTSTLQEQIGWMTGNPPIPVGDIYKRWIILGLNKIVRM
YSPVSILDIRQGPKEPFRDYVDRFFKTLRAEQATQEVKNWMTETLLVQNANPDCKSILRALGPGATLEEMMTACQGVGGPGHKARVLAEAMS
QVQNTDIMMQRGNFRGPKRIKCFNCGKEGHLARNCRAPRKKGCWKCGKEGHQMKDCTERQANFLGKIWPSSKGRPGNFPQSRPEPTAPPAEN
FGMGEEMISSPKQEQKDREQYPPLVSLKSLFGNDPLSQ$

Fig. 65D

2003_A1.anc gag.OPT

ATGGGCGCCCGCGCCTCCGTGCTGTCCGGCGGCAAGCTGGACGCCTGGGAGAAGATCCGCCTGCGCCCCGGCGGCAAGAAGAAGTACCGCCT
GAAGCACCTGGTGTGGGCCTCCCGCGAGCTGGAGCGCTTCGCCCTGAACCCCGGCCTGCTGGAGACCGCCGAGGGCTGCCAGCAGATCATGG
GCCAGCTGCAGCCCGCCCTGAAGACCGGCACCGAGGAGCTGCGCTCCCTGTACAACACCGTGGCCACCCTGTACTGCGTGCACCAGCGCATC
GAGGTGAAGGACACCAAGGAGGCCCTGGACAAGATCGAGGAGATCCAGAACAAGTCCAAGCAGAAGACCCAGCAGGCCGCCGCCGACACCGG
CAACTCCTCCAAGGTGTCCCAGAACTACCCCATCGTGCAGAACGCCCAGGGCCAGATGGTGCACCAGTCCCTGTCCCCCCGCACCCTGAACG
CCTGGGTGAAGGTGATCGAGGAGAAGGCCTTCTCCCCCGAGGTGATCCCCATGTTCTCCGCCCTGTCCGAGGGCGCCACCCCCCAGGACCTG
AACATGATGCTGAACATCGTGGGCGGCCACCAGGCCGCCATGCAGATGCTGAAGGACACCATCAACGAGGAGGCCGCCGAGTGGGACCGCCT
GCACCCCGTGCACGCCGGCCCCATCCCCCCCGGCCAGATGCGCGAGCCCCGCGGCTCCGACATCGCCGGCACCACCTCCACCCTGCAGGAGC
AGATCGGCTGGATGACCGGCAACCCCCCCATCCCCGTGGGCGACATCTACAAGCGCTGGATCATCCTGGGCCTGAACAAGATCGTGCGCATG
TACTCCCCCGTGTCCATCCTGGACATCCGCCAGGGCCCCAAGGAGCCCTTCCGCGACTACGTGGACCGCTTCTTCAAGACCCTGCGCGCCGA
GCAGGCCACCCAGGAGGTGAAGAACTGGATGACCGAGACCCTGCTGGTGCAGAACGCCAACCCCGACTGCAAGTCCATCCTGCGCGCCCTGG
GCCCCGGCGCCACCCTGGAGGAGATGATGACCGCCTGCCAGGGCGTGGGCGGCCCCGGCCACAAGGCCCGCGTGCTGGCCGAGGCCATGTCC
CAGGTGCAGAACACCGACATCATGATGCAGCGCGGCAACTTCCGCGGCCCCAAGCGCATCAAGTGCTTCAACTGCGGCAAGGAGGGCCACCT
GGCCCGCAACTGCCGCGCCCCCCGCAAGAAGGGCTGCTGGAAGTGCGGCAAGGAGGGCCACCAGATGAAGGACTGCACCGAGCGCCAGGCCA
ACTTCCTGGGCAAGATCTGGCCCTCCTCCAAGGGCCGCCCCGGCAACTTCCCCCAGTCCCGCCCCGAGCCCACCGCCCCCCCCGCCGAGAAC
TTCGGCATGGGCGAGGAGATGATCTCCTCCCCCAAGCAGGAGCAGAAGGACCGCGAGCAGTACCCCCCCCTGGTGTCCCTGAAGTCCCTGTT
CGGCAACGACCCCCTGTCCCAGTAA

Fig. 66A

5. 2003_CON_A2 gag.PEP

MGARASILSGGKLDAWEKIRLRPGGKKKYRLKHLVWASRELEKFSINPSLLETSEGCRQIIRQLQPALQTGTEELKSLYNTVAVLYCVHQRI
DVKDTKEALDKIEEEQNKCKQKTQHAAADTGNSSSSSQNYPIVQNAQGQMVHQAISPRTLNAWVKVVEEKAFSPEVIPMFTALSEGATPQDL
NTMLNTVGGHQAAMQMLKDTINEEAAEWDRLHPVHAGPIPPGQMREPRGSDIAGTTSTLQEQIGWMTSNPPIPVGEIYKRWIILGLNKIVRM
YSPVSILDIRQGPKEPFRDYVDRFFKTLRAEQATQEVKNWMTDTLLVQNANPDCKSILRALGPGATLEEMMTACQGVGGPSHKARVLAEAMS
QVQNTNTNIMMQRGNFRGQKRIKCFNCGKEGHLARNCRAPRKKGCWKCGKEGHQMKDCTERQANFLGKIWPSNKGRPGNFPQSRTEPTAPPA
ENLRMGEEITSSLKQELKTREPYNPAISLKSLFGNDPLSQ$

Fig. 66B

2003_CON_A2 gag.OPT

ATGGGCGCCCGCGCCTCCATCCTGTCCGGCGGCAAGCTGGACGCCTGGGAGAAGATCCGCCTGCGCCCCGGCGGCAAGAAGAAGTACCGCCT
GAAGCACCTGGTGTGGGCCTCCCGCGAGCTGGAGAAGTTCTCCATCAACCCCTCCCTGCTGGAGACCTCCGAGGGCTGCCGCCAGATCATCC
GCCAGCTGCAGCCCGCCCTGCAGACCGGCACCGAGGAGCTGAAGTCCCTGTACAACACCGTGGCCGTGCTGTACTGCGTGCACCAGCGCATC
GACGTGAAGGACACCAAGGAGGCCCTGGACAAGATCGAGGAGGAGCAGAACAAGTGCAAGCAGAAGACCCAGCACGCCGCCGCCGACACCGG
CAACTCCTCCTCCTCCTCCCAGAACTACCCCATCGTGCAGAACGCCCAGGGCCAGATGGTGCACCAGGCCATCTCCCCCCGCACCCTGAACG
CCTGGGTGAAGGTGGTGGAGGAGAAGGCCTTCTCCCCCGAGGTGATCCCCATGTTCACCGCCCTGTCCGAGGGCGCCACCCCCCAGGACCTG
AACACCATGCTGAACACCGTGGGCGGCCACCAGGCCGCCATGCAGATGCTGAAGGACACCATCAACGAGGAGGCCGCCGAGTGGGACCGCCT
GCACCCCGTGCACGCCGGCCCCATCCCCCCCGGCCAGATGCGCGAGCCCCGCGGCTCCGACATCGCCGGCACCACCTCCACCCTGCAGGAGC
AGATCGGCTGGATGACCTCCAACCCCCCCATCCCCGTGGGCGAGATCTACAAGCGCTGGATCATCCTGGGCCTGAACAAGATCGTGCGCATG
TACTCCCCCGTGTCCATCCTGGACATCCGCCAGGGCCCCAAGGAGCCCTTCCGCGACTACGTGGACCGCTTCTTCAAGACCCTGCGCGCCGA
GCAGGCCACCCAGGAGGTGAAGAACTGGATGACCGACACCCTGCTGGTGCAGAACGCCAACCCCGACTGCAAGTCCATCCTGCGCGCCCTGG
GCCCCGGCGCCACCCTGGAGGAGATGATGACCGCCTGCCAGGGCGTGGGCGGCCCCTCCCACAAGGCCCGCGTGCTGGCCGAGGCCATGTCC
CAGGTGCAGAACACCAACACCAACATCATGATGCAGCGCGGCAACTTCCGCGGCCAGAAGCGCATCAAGTGCTTCAACTGCGGCAAGGAGGG
CCACCTGGCCCGCAACTGCCGCGCCCCCCGCAAGAAGGGCTGCTGGAAGTGCGGCAAGGAGGGCCACCAGATGAAGGACTGCACCGAGCGCC
AGGCCAACTTCCTGGGCAAGATCTGGCCCTCCAACAAGGGCCGCCCCGGCAACTTCCCCCAGTCCCGCACCGAGCCCACCGCCCCCCCCGCC
GAGAACCTGCGCATGGGCGAGGAGATCACCTCCTCCCTGAAGCAGGAGCTGAAGACCCGCGAGCCCTACAACCCCGCCATCTCCCTGAAGTC
CCTGTTCGGCAACGACCCCCTGTCCCAGTAA

Fig. 67A

6. 2003_CON_B gag.PEP

MGARASVLSGGELDRWEKIRLRPGGKKKYKLKHIVWASRELERFAVNPGLLETSEGCRQILGQLQPSLQTGSEELRSLYNTVATLYCVHQRI
EVKDTKEALEKIEEEQNKSKKKAQQAAADTGNSSQVSQNYPIVQNLQGQMVHQAISPRTLNAWVKVVEEKAFSPEVIPMFSALSEGATPQDL
NTMLNTVGGHQAAMQMLKETINEEAAEWDRLHPVHAGPIAPGQMREPRGSDIAGTTSTLQEQIGWMTNNPPIPVGEIYKRWIILGLNKIVRM
YSPTSILDIRQGPKEPFRDYVDRFYKTLRAEQASQEVKNWMTETLLVQNANPDCKTILKALGPAATLEEMMTACQGVGGPGHKARVLAEAMS
QVTNSATIMMQRGNFRNQRKTVKCFNCGKEGHIAKNCRAPRKKGCWKCGKEGHQMKDCTERQANFLGKIWPSHKGRPGNFLQSRPEPTAPPE
ESFRFGEETTTPSQKQEPIDKELYPLAS$

Fig. 67B

2003_CON_B gag.OPT

ATGGGCGCCCGCGCCTCCGTGCTGTCCGGCGGCGAGCTGGACCGCTGGGAGAAGATCCGCCTGCGCCCCGGCGGCAAGAAGAAGTACAAGCT
GAAGCACATCGTGTGGGCCTCCCGCGAGCTGGAGCGCTTCGCCGTGAACCCCGGCCTGCTGGAGACCTCCGAGGGCTGCCGCCAGATCCTGG
GCCAGCTGCAGCCCTCCCTGCAGACCGGCTCCGAGGAGCTGCGCTCCCTGTACAACACCGTGGCCACCCTGTACTGCGTGCACCAGCGCATC
GAGGTGAAGGACACCAAGGAGGCCCTGGAGAAGATCGAGGAGGAGCAGAACAAGTCCAAGAAGAAGGCCCAGCAGGCCGCCGCCGACACCGG
CAACTCCTCCCAGGTGTCCCAGAACTACCCCATCGTGCAGAACCTGCAGGGCCAGATGGTGCACCAGGCCATCTCCCCCCGCACCCTGAACG
CCTGGGTGAAGGTGGTGGAGGAGAAGGCCTTCTCCCCCGAGGTGATCCCCATGTTCTCCGCCCTGTCCGAGGGCGCCACCCCCCAGGACCTG
AACACCATGCTGAACACCGTGGGCGGCCACCAGGCCGCCATGCAGATGCTGAAGGAGACCATCAACGAGGAGGCCGCCGAGTGGGACCGCCT
GCACCCCGTGCACGCCGGCCCCATCGCCCCCGGCCAGATGCGCGAGCCCCGCGGCTCCGACATCGCCGGCACCACCTCCACCCTGCAGGAGC
AGATCGGCTGGATGACCAACAACCCCCCCATCCCCGTGGGCGAGATCTACAAGCGCTGGATCATCCTGGGCCTGAACAAGATCGTGCGCATG
TACTCCCCCACCTCCATCCTGGACATCCGCCAGGGCCCCAAGGAGCCCTTCCGCGACTACGTGGACCGCTTCTACAAGACCCTGCGCGCCGA
GCAGGCCTCCCAGGAGGTGAAGAACTGGATGACCGAGACCCTGCTGGTGCAGAACGCCAACCCCGACTGCAAGACCATCCTGAAGGCCCTGG
GCCCCGCCGCCACCCTGGAGGAGATGATGACCGCCTGCCAGGGCGTGGGCGGCCCCGGCCACAAGGCCCGCGTGCTGGCCGAGGCCATGTCC
CAGGTGACCAACTCCGCCACCATCATGATGCAGCGCGGCAACTTCCGCAACCAGCGCAAGACCGTGAAGTGCTTCAACTGCGGCAAGGAGGG
CCACATCGCCAAGAACTGCCGCGCCCCCCGCAAGAAGGGCTGCTGGAAGTGCGGCAAGGAGGGCCACCAGATGAAGGACTGCACCGAGCGCC
AGGCCAACTTCCTGGGCAAGATCTGGCCCTCCCACAAGGGCCGCCCCGGCAACTTCCTGCAGTCCCGCCCCGAGCCCACCGCCCCCCCCGAG
GAGTCCTTCCGCTTCGGCGAGGAGACCACCACCCCCTCCCAGAAGCAGGAGCCCATCGACAAGGAGCTGTACCCCCTGGCCTCCTAA

Fig. 67C

7. 2003_B.anc gag.PEP

MGARASVLSGGKLDKWEKIRLRPGGKKKYKLKHIVWASRELERFAVNPGLLETSEGCRQILGQLQPALQTGSEELRSLYNTVATLYCVHQRI
EVKDTKEALDKIEEEQNKSKKKAQQAAADTGNSSQVSQNYPIVQNLQGQMVHQAISPRTLNAWVKVVEEKAFSPEVIPMFSALSEGATPQDL
NTMLNTVGGHQAAMQMLKETINEEAAEWDRLHPVHAGPIAPGQMREPRGSDIAGTTSTLQEQIGWMTNNPPIPVGEIYKRWIILGLNKIVRM
YSPISILDIRQGPKEPFRDYVDRFYKTLRAEQASQDVKNWMTETLLVQNANPDCKTILKALGPAATLEEMMTACQGVGGPGHKARVLAEAMS
QVTNSTTIMMQRGNFRDQRKIVKCFNCGKEGHIARNCRAPRKKGCWKCGKEGHQMKDCTERQANFLGKIWPSHKGRPGNFLQSRPEPTAPPE
ESFRFGEETTTPSQKQEPIDKELYPLASLKSLFGNDPSSQ$

Fig. 67D

2003_B.anc gag.OPT

ATGGGCGCCCGCGCCTCCGTGCTGTCCGGCGGCAAGCTGGACAAGTGGGAGAAGATCCGCCTGCGCCCCGGCGGCAAGAAGAAGTACAAGCT
GAAGCACATCGTGTGGGCCTCCCGCGAGCTGGAGCGCTTCGCCGTGAACCCCGGCCTGCTGGAGACCTCCGAGGGCTGCCGCCAGATCCTGG
GCCAGCTGCAGCCCGCCCTGCAGACCGGCTCCGAGGAGCTGCGCTCCCTGTACAACACCGTGGCCACCCTGTACTGCGTGCACCAGCGCATC
GAGGTGAAGGACACCAAGGAGGCCCTGGACAAGATCGAGGAGGAGCAGAACAAGTCCAAGAAGAAGGCCCAGCAGGCCGCCGCCGACACCGG
CAACTCCTCCCAGGTGTCCCAGAACTACCCCATCGTGCAGAACCTGCAGGGCCAGATGGTGCACCAGGCCATCTCCCCCCGCACCCTGAACG
CCTGGGTGAAGGTGGTGGAGGAGAAGGCCTTCTCCCCCGAGGTGATCCCCATGTTCTCCGCCCTGTCCGAGGGCGCCACCCCCCAGGACCTG
AACACCATGCTGAACACCGTGGGCGGCCACCAGGCCGCCATGCAGATGCTGAAGGAGACCATCAACGAGGAGGCCGCCGAGTGGGACCGCCT
GCACCCCGTGCACGCCGGCCCCATCGCCCCCGGCCAGATGCGCGAGCCCCGCGGCTCCGACATCGCCGGCACCACCTCCACCCTGCAGGAGC
AGATCGGCTGGATGACCAACAACCCCCCCATCCCCGTGGGCGAGATCTACAAGCGCTGGATCATCCTGGGCCTGAACAAGATCGTGCGCATG
TACTCCCCCATCTCCATCCTGGACATCCGCCAGGGCCCCAAGGAGCCCTTCCGCGACTACGTGGACCGCTTCTACAAGACCCTGCGCGCCGA
GCAGGCCTCCCAGGACGTGAAGAACTGGATGACCGAGACCCTGCTGGTGCAGAACGCCAACCCCGACTGCAAGACCATCCTGAAGGCCCTGG
GCCCCGCCGCCACCCTGGAGGAGATGATGACCGCCTGCCAGGGCGTGGGCGGCCCCGGCCACAAGGCCCGCGTGCTGGCCGAGGCCATGTCC
CAGGTGACCAACTCCACCACCATCATGATGCAGCGCGGCAACTTCCGCGACCAGCGCAAGATCGTGAAGTGCTTCAACTGCGGCAAGGAGGG
CCACATCGCCCGCAACTGCCGCGCCCCCCGCAAGAAGGGCTGCTGGAAGTGCGGCAAGGAGGGCCACCAGATGAAGGACTGCACCGAGCGCC
AGGCCAACTTCCTGGGCAAGATCTGGCCCTCCCACAAGGGCCGCCCCGGCAACTTCCTGCAGTCCCGCCCCGAGCCCACCGCCCCCCCCGAG
GAGTCCTTCCGCTTCGGCGAGGAGACCACCACCCCCTCCCAGAAGCAGGAGCCCATCGACAAGGAGCTGTACCCCCTGGCCTCCCTGAAGTC
CCTGTTCGGCAACGACCCCTCCTCCCAGTAA

Fig. 68A

8. 2003_CON_C gag.PEP

MGARASILRGGKLDKWEKIRLRPGGKKHYMLKHLVWASRELERFALNPGLLETSEGCKQIIKQLQPALQTGTEELRSLYNTVATLYCVHEKI
EVRDTKEALDKIEEEQNKSQQKTQQAKAADGKVSQNYPIVQNLQGQMVHQAISPRTLNAWVKVIEEKAFSPEVIPMFTALSEGATPQDLNTM
LNTVGGHQAAMQMLKDTINEEAAEWDRLHPVHAGPIAPGQMREPRGSDIAGTTSTLQEQIAWMTSNPPIPVGDIYKRWIILGLNKIVRMYSP
VSILDIKQGPKEPFRDYVDRFFKTLRAEQATQDVKNWMTDTLLVQNANPDCKTILRALGPGATLEEMMTACQGVGGPSHKARVLAEAMSQAN
NTNIMMQRSNFKGPKRIVKCFNCGKEGHIARNCRAPRKKGCWKCGKEGHQMKDCTERQANFLGKIWPSHKGRPGNFLQNRPEPTAPPAESFR
FEETTPAPKQEPKDREPLTSLKSLFGSDPLSQ$

Fig. 68B

2003_CON_C gag.OPT

ATGGGCGCCCGCGCCTCCATCCTGCGCGGCGGCAAGCTGGACAAGTGGGAGAAGATCCGCCTGCGCCCCGGCGGCAAGAAGCACTACATGCT
GAAGCACCTGGTGTGGGCCTCCCGCGAGCTGGAGCGCTTCGCCCTGAACCCCGGCCTGCTGGAGACCTCCGAGGGCTGCAAGCAGATCATCA
AGCAGCTGCAGCCCGCCCTGCAGACCGGCACCGAGGAGCTGCGCTCCCTGTACAACACCGTGGCCACCCTGTACTGCGTGCACGAGAAGATC
GAGGTGCGCGACACCAAGGAGGCCCTGGACAAGATCGAGGAGGAGCAGAACAAGTCCCAGCAGAAGACCCAGCAGGCCAAGGCCGCCGACGG
CAAGGTGTCCCAGAACTACCCCATCGTGCAGAACCTGCAGGGCCAGATGGTGCACCAGGCCATCTCCCCCCGCACCCTGAACGCCTGGGTGA
AGGTGATCGAGGAGAAGGCCTTCTCCCCCGAGGTGATCCCCATGTTCACCGCCCTGTCCGAGGGCGCCACCCCCCAGGACCTGAACACCATG
CTGAACACCGTGGGCGGCCACCAGGCCGCCATGCAGATGCTGAAGGACACCATCAACGAGGAGGCCGCCGAGTGGGACCGCCTGCACCCCGT
GCACGCCGGCCCCATCGCCCCCGGCCAGATGCGCGAGCCCCGCGGCTCCGACATCGCCGGCACCACCTCCACCCTGCAGGAGCAGATCGCCT
GGATGACCTCCAACCCCCCCATCCCCGTGGGCGACATCTACAAGCGCTGGATCATCCTGGGCCTGAACAAGATCGTGCGCATGTACTCCCCC
GTGTCCATCCTGGACATCAAGCAGGGCCCCAAGGAGCCCTTCCGCGACTACGTGGACCGCTTCTTCAAGACCCTGCGCGCCGAGCAGGCCAC
CCAGGACGTGAAGAACTGGATGACCGACACCCTGCTGGTGCAGAACGCCAACCCCGACTGCAAGACCATCCTGCGCGCCCTGGGCCCCGGCG
CCACCCTGGAGGAGATGATGACCGCCTGCCAGGGCGTGGGCGGCCCCTCCCACAAGGCCCGCGTGCTGGCCGAGGCCATGTCCCAGGCCAAC
AACACCAACATCATGATGCAGCGCTCCAACTTCAAGGGCCCCAAGCGCATCGTGAAGTGCTTCAACTGCGGCAAGGAGGGCCACATCGCCCG
CAACTGCCGCGCCCCCCGCAAGAAGGGCTGCTGGAAGTGCGGCAAGGAGGGCCACCAGATGAAGGACTGCACCGAGCGCCAGGCCAACTTCC
TGGGCAAGATCTGGCCCTCCCACAAGGGCCGCCCCGGCAACTTCCTGCAGAACCGCCCCGAGCCCACCGCCCCCCCCGCCGAGTCCTTCCGC
TTCGAGGAGACCACCCCCGCCCCCAAGCAGGAGCCCAAGGACCGCGAGCCCCTGACCTCCCTGAAGTCCCTGTTCGGCTCCGACCCCCTGTC
CCAGTAA

Fig. 68C

9. 2003_C.anc.gag.PEP

MGARASILRGGKLDTWEKIRLRPGGKKHYMIKHLVWASRELERFALNPGLLETSEGCKQIMKQLQPALQTGTEELRSLYNTVATLYCVHERI
EVRDTKEALDKIEEEQNKSQQKTQQAEAADGDNGKVSQNYPIVQNLQGQMVHQAISPRTLNAWVKVVEEKAFSPEVIPMFTALSEGATPQDL
NTMLNTVGGHQAAMQMLKDTINEEAAEWDRLHPVHAGPVAPGQMREPRGSDIAGTTSTLQEQIAWMTSNPPIPVGDIYKRWIILGLNKIVRM
YSPVSILDIKQGPKEPFRDYVDRFFKTLRAEQATQDVKNWMTDTLLVQNANPDCKTILRALGPGATLEEMMTACQGVGGPGHKARVLAEAMS
QANNTNIMMQRSNFKGPKRIVKCFNCGKEGHIARNCRAPRKKGCWKCGKEGHQMKDCTERQANFLGKIWPSHKGRPGNFLQSRPEPTAPPAE
SFRFEETTPAPKQEPKDREPLTSLKSLFGSDPLSQ$

Fig. 68D

2003_C.anc.gag.OPT

ATGGGCGCCCGCGCCTCCATCCTGCGCGGCGGCAAGCTGGACACCTGGGAGAAGATCCGCCTGCGCCCCGGCGGCAAGAAGCACTACATGAT
CAAGCACCTGGTGTGGGCCTCCCGCGAGCTGGAGCGCTTCGCCCTGAACCCCGGCCTGCTGGAGACCTCCGAGGGCTGCAAGCAGATCATGA
AGCAGCTGCAGCCCGCCCTGCAGACCGGCACCGAGGAGCTGCGCTCCCTGTACAACACCGTGGCCACCCTGTACTGCGTGCACGAGCGCATC
GAGGTGCGCGACACCAAGGAGGCCCTGGACAAGATCGAGGAGGAGCAGAACAAGTCCCAGCAGAAGACCCAGCAGGCCGAGGCCGCCGACGG
CGACAACGGCAAGGTGTCCCAGAACTACCCCATCGTGCAGAACCTGCAGGGCCAGATGGTGCACCAGGCCATCTCCCCCCGCACCCTGAACG
CCTGGGTGAAGGTGGTGGAGGAGAAGGCCTTCTCCCCCGAGGTGATCCCCATGTTCACCGCCCTGTCCGAGGGCGCCACCCCCCAGGACCTG
AACACCATGCTGAACACCGTGGGCGGCCACCAGGCCGCCATGCAGATGCTGAAGGACACCATCAACGAGGAGGCCGCCGAGTGGGACCGCCT
GCACCCCGTGCACGCCGGCCCCGTGGCCCCCGGCCAGATGCGCGAGCCCCGCGGCTCCGACATCGCCGGCACCACCTCCACCCTGCAGGAGC
AGATCGCCTGGATGACCTCCAACCCCCCCATCCCCGTGGGCGACATCTACAAGCGCTGGATCATCCTGGGCCTGAACAAGATCGTGCGCATG
TACTCCCCCGTGTCCATCCTGGACATCAAGCAGGGCCCCAAGGAGCCCTTCCGCGACTACGTGGACCGCTTCTTCAAGACCCTGCGCGCCGA
GCAGGCCACCCAGGACGTGAAGAACTGGATGACCGACACCCTGCTGGTGCAGAACGCCAACCCCGACTGCAAGACCATCCTGCGCGCCCTGG
GCCCCGGCGCCACCCTGGAGGAGATGATGACCGCCTGCCAGGGCGTGGGCGGCCCCGGCCACAAGGCCCGCGTGCTGGCCGAGGCCATGTCC
CAGGCCAACAACACCAACATCATGATGCAGCGCTCCAACTTCAAGGGCCCCAAGCGCATCGTGAAGTGCTTCAACTGCGGCAAGGAGGGCCA
CATCGCCCGCAACTGCCGCGCCCCCCGCAAGAAGGGCTGCTGGAAGTGCGGCAAGGAGGGCCACCAGATGAAGGACTGCACCGAGCGCCAGG
CCAACTTCCTGGGCAAGATCTGGCCCTCCCACAAGGGCCGCCCCGGCAACTTCCTGCAGTCCCGCCCCGAGCCCACCGCCCCCCCCGCCGAG
TCCTTCCGCTTCGAGGAGACCACCCCCGCCCCCAAGCAGGAGCCCAAGGACCGCGAGCCCCTGACCTCCCTGAAGTCCCTGTTCGGCTCCGA
CCCCCTGTCCCAGTAA

Fig. 69A

10. 2003_CON_D gag.PEP

MGARASVLSGGKLDAWEKIRLRPGGKKKYRLKHIVWASRELERFALNPGLLETSEGCKQIIGQLQPAIQTGSEELRSLYNTVATLYCVHERI
EVKDTKEALEKIEEEQNKSKKKAQQAAADTGNSSQVSQNYPIVQNLQGQMVHQAISPRTLNAWVKVIEEKAFSPEVIPMFSALSEGATPQDL
NTMLNTVGGHQAAMQMLKETINEEAAEWDRLHPVHAGPVAPGQMREPRGSDIAGTTSTLQEQIGWMTSNPPIPVGEIYKRWIILGLNKIVRM
YSPVSILDIRQGPKEPFRDYVDRFYKTLRAEQASQDVKNWMTETLLVQNANPDCKTILKALGPEATLEEMMTACQGVGGPSHKARVLAEAMS
QATNSAAVMMQRGNFKGPRKIIKCFNCGKEGHIAKNCRAPRKKGCWKCGKEGHQMKDCTERQANFLGKIWPSHKGRPGNFLQSRPEPTAPPA
ESFGFGEEITPSQKQEQKDKELYPLTSLKSLFGNDPLSQ$

Fig. 69B

2003_CON_D gag.OPT

ATGGGCGCCCGCGCCTCCGTGCTGTCCGGCGGCAAGCTGGACGCCTGGGAGAAGATCCGCCTGCGCCCCGGCGGCAAGAAGAAGTACCGCCT
GAAGCACATCGTGTGGGCCTCCCGCGAGCTGGAGCGCTTCGCCCTGAACCCCGGCCTGCTGGAGACCTCCGAGGGCTGCAAGCAGATCATCG
GCCAGCTGCAGCCCGCCATCCAGACCGGCTCCGAGGAGCTGCGCTCCCTGTACAACACCGTGGCCACCCTGTACTGCGTGCACGAGCGCATC
GAGGTGAAGGACACCAAGGAGGCCCTGGAGAAGATCGAGGAGGAGCAGAACAAGTCCAAGAAGAAGGCCCAGCAGGCCGCCGCCGACACCGG
CAACTCCTCCCAGGTGTCCCAGAACTACCCCATCGTGCAGAACCTGCAGGGCCAGATGGTGCACCAGGCCATCTCCCCCCGCACCCTGAACG
CCTGGGTGAAGGTGATCGAGGAGAAGGCCTTCTCCCCCGAGGTGATCCCCATGTTCTCCGCCCTGTCCGAGGGCGCCACCCCCCAGGACCTG
AACACCATGCTGAACACCGTGGGCGGCCACCAGGCCGCCATGCAGATGCTGAAGGAGACCATCAACGAGGAGGCCGCCGAGTGGGACCGCCT
GCACCCCGTGCACGCCGGCCCCGTGGCCCCCGGCCAGATGCGCGAGCCCCGCGGCTCCGACATCGCCGGCACCACCTCCACCCTGCAGGAGC
AGATCGGCTGGATGACCTCCAACCCCCCCATCCCCGTGGGCGAGATCTACAAGCGCTGGATCATCCTGGGCCTGAACAAGATCGTGCGCATG
TACTCCCCCGTGTCCATCCTGGACATCCGCCAGGGCCCCAAGGAGCCCTTCCGCGACTACGTGGACCGCTTCTACAAGACCCTGCGCGCCGA
GCAGGCCTCCCAGGACGTGAAGAACTGGATGACCGAGACCCTGCTGGTGCAGAACGCCAACCCCGACTGCAAGACCATCCTGAAGGCCCTGG
GCCCCGAGGCCACCCTGGAGGAGATGATGACCGCCTGCCAGGGCGTGGGCGGCCCCTCCCACAAGGCCCGCGTGCTGGCCGAGGCCATGTCC
CAGGCCACCAACTCCGCCGCCGTGATGATGCAGCGCGGCAACTTCAAGGGCCCCCGCAAGATCATCAAGTGCTTCAACTGCGGCAAGGAGGG
CCACATCGCCAAGAACTGCCGCGCCCCCCGCAAGAAGGGCTGCTGGAAGTGCGGCAAGGAGGGCCACCAGATGAAGGACTGCACCGAGCGCC
AGGCCAACTTCCTGGGCAAGATCTGGCCCTCCCACAAGGGCCGCCCCGGCAACTTCCTGCAGTCCCGCCCCGAGCCCACCGCCCCCCCCGCC
GAGTCCTTCGGCTTCGGCGAGGAGATCACCCCCTCCCAGAAGCAGGAGCAGAAGGACAAGGAGCTGTACCCCCTGACCTCCCTGAAGTCCCT
GTTCGGCAACGACCCCCTGTCCCAGTAA

Fig. 70A

11. 2003_CON_F gag.PEP

MGARASVLSGGKLDAWEKIRLRPGGKKKYRMKHLVWASRELERFALDPGLLETSEGCQKIIGQLQPSLQTGSEELRSLYNTVAVLYCVHQKV
EVKDTKEALEKLEEEQNKSQQKTQQAAADKGVSQNYPIVQNLQGQMVHQAISPRTLNAWVKVIEEKAFSPEVIPMFSALSEGATPQDLNTML
NTVGGHQAAMQMLKDTINEEAAEWDRLHPVHAGPIPPGQMREPRGSDIAGTTSTLQEQIQWMTSNPPVPVGDIYKRWIILGLNKIVRMYSPV
SILDIRQGPKEPFRDYVDRFFKTLRAEQATQEVKGWMTDTLLVQNANPDCKTILKALGPGATLEEMMTACQGVGGPGHKARVLAEAMSQATN
TAIMMQKSNFKGQRRIVKCFNCGKEGHIAKNCRAPRKKGCWKCGREGHQMKDCTERQANFLGKIWPSNKGRPGNFLQSRPEPTAPPAESFGF
REEITPSPKQEQKDEGLYPPLASLKSLFGNDP$

Fig. 70B

2003_CON_F gag.OPT

ATGGGCGCCCGCGCCTCCGTGCTGTCCGGCGGCAAGCTGGACGCCTGGGAGAAGATCCGCCTGCGCCCCGGCGGCAAGAAGAAGTACCGCAT
GAAGCACCTGGTGTGGGCCTCCCGCGAGCTGGAGCGCTTCGCCCTGGACCCCGGCCTGCTGGAGACCTCCGAGGGCTGCCAGAAGATCATCG
GCCAGCTGCAGCCCTCCCTGCAGACCGGCTCCGAGGAGCTGCGCTCCCTGTACAACACCGTGGCCGTGCTGTACTGCGTGCACCAGAAGGTG
GAGGTGAAGGACACCAAGGAGGCCCTGGAGAAGCTGGAGGAGGAGCAGAACAAGTCCCAGCAGAAGACCCAGCAGGCCGCCGCCGACAAGGG
CGTGTCCCAGAACTACCCCATCGTGCAGAACCTGCAGGGCCAGATGGTGCACCAGGCCATCTCCCCCCGCACCCTGAACGCCTGGGTGAAGG
TGATCGAGGAGAAGGCCTTCTCCCCCGAGGTGATCCCCATGTTCTCCGCCCTGTCCGAGGGCGCCACCCCCCAGGACCTGAACACCATGCTG
AACACCGTGGGCGGCCACCAGGCCGCCATGCAGATGCTGAAGGACACCATCAACGAGGAGGCCGCCGAGTGGGACCGCCTGCACCCCGTGCA
CGCCGGCCCCATCCCCCCCGGCCAGATGCGCGAGCCCCGCGGCTCCGACATCGCCGGCACCACCTCCACCCTGCAGGAGCAGATCCAGTGGA
TGACCTCCAACCCCCCCGTGCCCGTGGGCGACATCTACAAGCGCTGGATCATCCTGGGCCTGAACAAGATCGTGCGCATGTACTCCCCCGTG
TCCATCCTGGACATCCGCCAGGGCCCCAAGGAGCCCTTCCGCGACTACGTGGACCGCTTCTTCAAGACCCTGCGCGCCGAGCAGGCCACCCA
GGAGGTGAAGGGCTGGATGACCGACACCCTGCTGGTGCAGAACGCCAACCCCGACTGCAAGACCATCCTGAAGGCCCTGGGCCCCGGCGCCA
CCCTGGAGGAGATGATGACCGCCTGCCAGGGCGTGGGCGGCCCCGGCCACAAGGCCCGCGTGCTGGCCGAGGCCATGTCCCAGGCCACCAAC
ACCGCCATCATGATGCAGAAGTCCAACTTCAAGGGCCAGCGCCGCATCGTGAAGTGCTTCAACTGCGGCAAGGAGGGCCACATCGCCAAGAA
CTGCCGCGCCCCCCGCAAGAAGGGCTGCTGGAAGTGCGGCCGCGAGGGCCACCAGATGAAGGACTGCACCGAGCGCCAGGCCAACTTCCTGG
GCAAGATCTGGCCCTCCAACAAGGGCCGCCCCGGCAACTTCCTGCAGTCCCGCCCCGAGCCCACCGCCCCCCCCGCCGAGTCCTTCGGCTTC
CGCGAGGAGATCACCCCCTCCCCCAAGCAGGAGCAGAAGGACGAGGGCCTGTACCCCCCCCTGGCCTCCCTGAAGTCCCTGTTCGGCAACGA
CCCCTAA

Fig. 71A

12. 2003_CON_G gag.PEP

MGARASVLSGGKLDAWEKIRLRPGGKKKYRMKHLVWASRELERFALNPDLLETAEGCQQIMGQLQPALQTGTEELRSLFNTVATLYCVHQRI
EVKDTKEALEEVEKIQKKSQQKTQQAAMDEGNSSQVSQNYPIVQNAQGQMVHQAISPRTLNAWVKVVEEKAFSPEVIPMFSALSEGATPQDL
NTMLNTVGGHQAAMQMLKDTINEEAAEWDRMHPQQAGPIPPGQIREPRGSDIAGTTSTLQEQIRWMTSNPPIPVGEIYKRWIILGLNKIVRM
YSPVSILDIRQGPKEPFRDYVDRFFKTLRAEQATQEVKGWMTDTLLVQNANPDCKTILRALGPGATLEEMMTACQGVGGPSHKARVLAEAMS
QASGAAAAIMMQKSNFKGPRRTIKCFNCGKEGHLARNCRAPRKKGCWKCGKEGHQMKDCTERQANFLGKIWPSNKGRPGNFLQNRPEPTAPP
AESFGFGEEIAPSPKQEQKEKELYPLASLKSLFGSDP$

Fig.71B

2003_CON_G gag.OPT

ATGGGCGCCCGCGCCTCCGTGCTGTCCGGCGGCAAGCTGGACGCCTGGGAGAAGATCCGCCTGCGCCCCGGCGGCAAGAAGAAGTACCGCAT
GAAGCACCTGGTGTGGGCCTCCCGCGAGCTGGAGCGCTTCGCCCTGAACCCCGACCTGCTGGAGACCGCCGAGGGCTGCCAGCAGATCATGG
GCCAGCTGCAGCCCGCCCTGCAGACCGGCACCGAGGAGCTGCGCTCCCTGTTCAACACCGTGGCCACCCTGTACTGCGTGCACCAGCGCATC
GAGGTGAAGGACACCAAGGAGGCCCTGGAGGAGGTGGAGAAGATCCAGAAGAAGTCCCAGCAGAAGACCCAGCAGGCCGCCATGGACGAGGG
CAACTCCTCCCAGGTGTCCCAGAACTACCCCATCGTGCAGAACGCCCAGGGCCAGATGGTGCACCAGGCCATCTCCCCCCGCACCCTGAACG
CCTGGGTGAAGGTGGTGGAGGAGAAGGCCTTCTCCCCCGAGGTGATCCCCATGTTCTCCGCCCTGTCCGAGGGCGCCACCCCCCAGGACCTG
AACACCATGCTGAACACCGTGGGCGGCCACCAGGCCGCCATGCAGATGCTGAAGGACACCATCAACGAGGAGGCCGCCGAGTGGGACCGCAT
GCACCCCCAGCAGGCCGGCCCCATCCCCCCCGGCCAGATCCGCGAGCCCCGCGGCTCCGACATCGCCGGCACCACCTCCACCCTGCAGGAGC
AGATCCGCTGGATGACCTCCAACCCCCCCATCCCCGTGGGCGAGATCTACAAGCGCTGGATCATCCTGGGCCTGAACAAGATCGTGCGCATG
TACTCCCCCGTGTCCATCCTGGACATCCGCCAGGGCCCCAAGGAGCCCTTCCGCGACTACGTGGACCGCTTCTTCAAGACCCTGCGCGCCGA
GCAGGCCACCCAGGAGGTGAAGGGCTGGATGACCGACACCCTGCTGGTGCAGAACGCCAACCCCGACTGCAAGACCATCCTGCGCGCCCTGG
GCCCCGGCGCCACCCTGGAGGAGATGATGACCGCCTGCCAGGGCGTGGGCGGCCCCTCCCACAAGGCCCGCGTGCTGGCCGAGGCCATGTCC
CAGGCCTCCGGCGCCGCCGCCGCCATCATGATGCAGAAGTCCAACTTCAAGGGCCCCCGCCGCACCATCAAGTGCTTCAACTGCGGCAAGGA
GGGCCACCTGGCCCGCAACTGCCGCGCCCCCCGCAAGAAGGGCTGCTGGAAGTGCGGCAAGGAGGGCCACCAGATGAAGGACTGCACCGAGC
GCCAGGCCAACTTCCTGGGCAAGATCTGGCCCTCCAACAAGGGCCGCCCCGGCAACTTCCTGCAGAACCGCCCCGAGCCCACCGCCCCCCCC
GCCGAGTCCTTCGGCTTCGGCGAGGAGATCGCCCCCTCCCCCAAGCAGGAGCAGAAGGAGAAGGAGCTGTACCCCCTGGCCTCCCTGAAGTC
CCTGTTCGGCTCCGACCCCTAA

Fig. 72A

13. 2003_CON_H gag.PEP

MGARASVLSGGKLDAWEKIRLRPGGKKKYRLKHLVWASRELERFALNPGLLETAEGCLQIIEQLQPAIKTGTEELQSLFNTVAVLYCVHQRI
DVKDTKEALGKIEEIQNKSQQKTQQAAADKEKDNKVSQNYPIVQNAQGQMVHQAISPRTLNAWVKVVEEKAFSPEVIPMFSALSEGATPQDL
NAMLNTVGGHQAAMQMLKDTINEEAAEWDRLHPVHAGPIPPGQMREPRGSDIAGTTSTLQEQIAWMTGNPPIPVGDIYKRWIILGLNKIVRM
YSPVSILDIKQGPKEPFRDYVDRFFKTLRAEQATQDVKNWMTDTLLVQNANPDCKTILRALGQGASIEEMMTACQGVGGPSHKARVLAEAMS
QVTNANAAIMMQKGNFKGPRKIVKCFNCGKEGHIARNCRAPRKKGCWKCGREGHQMKDCTERQANFLGKIWPSSKGRPGNFLQSRPEPTAPP
AESFGFGEEMTPSPKQELKDKEPPLASLRSLFGNDPLSQ$

Fig. 72B

2003_CON_H gag.OPT

ATGGGCGCCCGCGCCTCCGTGCTGTCCGGCGGCAAGCTGGACGCCTGGGAGAAGATCCGCCTGCGCCCCGGCGGCAAGAAGAAGTACCGCCT
GAAGCACCTGGTGTGGGCCTCCCGCGAGCTGGAGCGCTTCGCCCTGAACCCCGGCCTGCTGGAGACCGCCGAGGGCTGCCTGCAGATCATCG
AGCAGCTGCAGCCCGCCATCAAGACCGGCACCGAGGAGCTGCAGTCCCTGTTCAACACCGTGGCCGTGCTGTACTGCGTGCACCAGCGCATC
GACGTGAAGGACACCAAGGAGGCCCTGGGCAAGATCGAGGAGATCCAGAACAAGTCCCAGCAGAAGACCCAGCAGGCCGCCGCCGACAAGGA
GAAGGACAACAAGGTGTCCCAGAACTACCCCATCGTGCAGAACGCCCAGGGCCAGATGGTGCACCAGGCCATCTCCCCCCGCACCCTGAACG
CCTGGGTGAAGGTGGTGGAGGAGAAGGCCTTCTCCCCCGAGGTGATCCCCATGTTCTCCGCCCTGTCCGAGGGCGCCACCCCCCAGGACCTG
AACGCCATGCTGAACACCGTGGGCGGCCACCAGGCCGCCATGCAGATGCTGAAGGACACCATCAACGAGGAGGCCGCCGAGTGGGACCGCCT
GCACCCCGTGCACGCCGGCCCCATCCCCCCCGGCCAGATGCGCGAGCCCCGCGGCTCCGACATCGCCGGCACCACCTCCACCCTGCAGGAGC
AGATCGCCTGGATGACCGGCAACCCCCCCATCCCCGTGGGCGACATCTACAAGCGCTGGATCATCCTGGGCCTGAACAAGATCGTGCGCATG
TACTCCCCCGTGTCCATCCTGGACATCAAGCAGGGCCCCAAGGAGCCCTTCCGCGACTACGTGGACCGCTTCTTCAAGACCCTGCGCGCCGA
GCAGGCCACCCAGGACGTGAAGAACTGGATGACCGACACCCTGCTGGTGCAGAACGCCAACCCCGACTGCAAGACCATCCTGCGCGCCCTGG
GCCAGGGCGCCTCCATCGAGGAGATGATGACCGCCTGCCAGGGCGTGGGCGGCCCCTCCCACAAGGCCCGCGTGCTGGCCGAGGCCATGTCC
CAGGTGACCAACGCCAACGCCGCCATCATGATGCAGAAGGGCAACTTCAAGGGCCCCCGCAAGATCGTGAAGTGCTTCAACTGCGGCAAGGA
GGGCCACATCGCCCGCAACTGCCGCGCCCCCCGCAAGAAGGGCTGCTGGAAGTGCGGCCGCGAGGGCCACCAGATGAAGGACTGCACCGAGC
GCCAGGCCAACTTCCTGGGCAAGATCTGGCCCTCCTCCAAGGGCCGCCCCGGCAACTTCCTGCAGTCCCGCCCCGAGCCCACCGCCCCCCCC
GCCGAGTCCTTCGGCTTCGGCGAGGAGATGACCCCCTCCCCCAAGCAGGAGCTGAAGGACAAGGAGCCCCCCCTGGCCTCCCTGCGCTCCCT
GTTCGGCAACGACCCCCTGTCCCAGTAA

Fig. 73A

14. 2003_CON_K gag.PEP

MGARASVLSGGKLDTWEKIRLRPGGKKKYRLKHLVWASRELERFALNPSLLETTEGCRQIIRQLQPSLQTGSEELKSLFNTVATLYCVHQRI
EVRDTKEALDKLEEEQNKSQQKTQQETADKGVSQNYPIVQNLQGQMVHQALSPRTLNAWVKVIEEKAFSPEVIPMFSALSEGATPQDLNTML
NTVGGHQAAMQMLKDTINEEAAEWDRLHPVHAGPIPPGQMREPRGSDIAGTTSTLQEQITWMTSNPPVPVGEIYKRWIILGLNKIVRMYSPV
SILDIRQGPKEPFRDYVDRFFKTLRAEQATQEVKNWMTDTLLVQNANPDCKTILKALGPGASLEEMMTACQGVGGPGHKARILAEAMSQVTN
TAVMMQRGNFKGQRKIIKCFNCGKEGHIARNCRAPRKKGCWKCGKEGHQMKDCTERQANFLGKIWPSNKGRPGNFLQSRPEPTAPPAESFGF
GEEITPSPRQETKDKEQGPPLTSLKSLFGNDPLSQ$

Fig. 73B

2003_CON_K gag.OPT

ATGGGCGCCCGCGCCTCCGTGCTGTCCGGCGGCAAGCTGGACACCTGGGAGAAGATCCGCCTGCGCCCCGGCGGCAAGAAGAAGTACCGCCT
GAAGCACCTGGTGTGGGCCTCCCGCGAGCTGGAGCGCTTCGCCCTGAACCCCTCCCTGCTGGAGACCACCGAGGGCTGCCGCCAGATCATCC
GCCAGCTGCAGCCCTCCCTGCAGACCGGCTCCGAGGAGCTGAAGTCCCTGTTCAACACCGTGGCCACCCTGTACTGCGTGCACCAGCGCATC
GAGGTGCGCGACACCAAGGAGGCCCTGGACAAGCTGGAGGAGGAGCAGAACAAGTCCCAGCAGAAGACCCAGCAGGAGACCGCCGACAAGGG
CGTGTCCCAGAACTACCCCATCGTGCAGAACCTGCAGGGCCAGATGGTGCACCAGGCCCTGTCCCCCCGCACCCTGAACGCCTGGGTGAAGG
TGATCGAGGAGAAGGCCTTCTCCCCCGAGGTGATCCCCATGTTCTCCGCCCTGTCCGAGGGCGCCACCCCCCAGGACCTGAACACCATGCTG
AACACCGTGGGCGGCCACCAGGCCGCCATGCAGATGCTGAAGGACACCATCAACGAGGAGGCCGCCGAGTGGGACCGCCTGCACCCCGTGCA
CGCCGGCCCCATCCCCCCCGGCCAGATGCGCGAGCCCCGCGGCTCCGACATCGCCGGCACCACCTCCACCCTGCAGGAGCAGATCACCTGGA
TGACCTCCAACCCCCCCGTGCCCGTGGGCGAGATCTACAAGCGCTGGATCATCCTGGGCCTGAACAAGATCGTGCGCATGTACTCCCCCGTG
TCCATCCTGGACATCCGCCAGGGCCCCAAGGAGCCCTTCCGCGACTACGTGGACCGCTTCTTCAAGACCCTGCGCGCCGAGCAGGCCACCCA
GGAGGTGAAGAACTGGATGACCGACACCCTGCTGGTGCAGAACGCCAACCCCGACTGCAAGACCATCCTGAAGGCCCTGGGCCCCGGCGCCT
CCCTGGAGGAGATGATGACCGCCTGCCAGGGCGTGGGCGGCCCCGGCCACAAGGCCCGCATCCTGGCCGAGGCCATGTCCCAGGTGACCAAC
ACCGCCGTGATGATGCAGCGCGGCAACTTCAAGGGCCAGCGCAAGATCATCAAGTGCTTCAACTGCGGCAAGGAGGGCCACATCGCCCGCAA
CTGCCGCGCCCCCCGCAAGAAGGGCTGCTGGAAGTGCGGCAAGGAGGGCCACCAGATGAAGGACTGCACCGAGCGCCAGGCCAACTTCCTGG
GCAAGATCTGGCCCTCCAACAAGGGCCGCCCCGGCAACTTCCTGCAGTCCCGCCCCGAGCCCACCGCCCCCCCCGCCGAGTCCTTCGGCTTC
GGCGAGGAGATCACCCCCTCCCCCCGCCAGGAGACCAAGGACAAGGAGCAGGGCCCCCCCCTGACCTCCCTGAAGTCCCTGTTCGGCAACGA
CCCCCTGTCCCAGTAA

Fig. 74A

15. 2003_CON_01_AE gag.PEP

MGARASVLSGGKLDAWEKIRLRPGGKKKYRMKHLVWASRELERFALNPGLLETAEGCQQIIEQLQSTLKTGSEELKSLFNTVATLWCVHQRI
EVKDTKEALDKIEEVQNKSQQKTQQAAAGTGSSSKVSQNYPIVQNAQGQMVHQPLSPRTLNAWVKVVEEKGFNPEVIPMFSALSEGATPQDL
NMMLNIVGGHQAAMQMLKETINEEAAEWDRVHPVHAGPIPPGQMREPRGSDIAGTTSTLQEQIGWMTNNPPIPVGDIYKRWIILGLNKIVRM
YSPVSILDIRQGPKEPFRDYVDRFYKTLRAEQATQEVKNWMTETLLVQNANPDCKSILKALGTGATLEEMMTACQGVGGPSHKARVLAEAMS
QAQHANIMMQRGNFKGQKRIKCFNCGKEGHLARNCRAPRKKGCWKCGKEGHQMKDCTERQANFLGKIWPSNKGRPGNFPQSRPEPTAPPAEN
WGMGEEITSLPKQEQKDKEHPPPLVSLKSLFGNDPLSQ$

Fig. 74B

2003_CON_01_AE gag.OPT

ATGGGCGCCCGCGCCTCCGTGCTGTCCGGCGGCAAGCTGGACGCCTGGGAGAAGATCCGCCTGCGCCCCGGCGGCAAGAAGAAGTACCGCAT
GAAGCACCTGGTGTGGGCCTCCCGCGAGCTGGAGCGCTTCGCCCTGAACCCCGGCCTGCTGGAGACCGCCGAGGGCTGCCAGCAGATCATCG
AGCAGCTGCAGTCCACCCTGAAGACCGGCTCCGAGGAGCTGAAGTCCCTGTTCAACACCGTGGCCACCCTGTGGTGCGTGCACCAGCGCATC
GAGGTGAAGGACACCAAGGAGGCCCTGGACAAGATCGAGGAGGTGCAGAACAAGTCCCAGCAGAAGACCCAGCAGGCCGCCGCCGGCACCGG
CTCCTCCTCCAAGGTGTCCCAGAACTACCCCATCGTGCAGAACGCCCAGGGCCAGATGGTGCACCAGCCCCTGTCCCCCCGCACCCTGAACG
CCTGGGTGAAGGTGGTGGAGGAGAAGGGCTTCAACCCCGAGGTGATCCCCATGTTCTCCGCCCTGTCCGAGGGCGCCACCCCCCAGGACCTG
AACATGATGCTGAACATCGTGGGCGGCCACCAGGCCGCCATGCAGATGCTGAAGGAGACCATCAACGAGGAGGCCGCCGAGTGGGACCGCGT
GCACCCCGTGCACGCCGGCCCCATCCCCCCCGGCCAGATGCGCGAGCCCCGCGGCTCCGACATCGCCGGCACCACCTCCACCCTGCAGGAGC
AGATCGGCTGGATGACCAACAACCCCCCCATCCCCGTGGGCGACATCTACAAGCGCTGGATCATCCTGGGCCTGAACAAGATCGTGCGCATG
TACTCCCCCGTGTCCATCCTGGACATCCGCCAGGGCCCCAAGGAGCCCTTCCGCGACTACGTGGACCGCTTCTACAAGACCCTGCGCGCCGA
GCAGGCCACCCAGGAGGTGAAGAACTGGATGACCGAGACCCTGCTGGTGCAGAACGCCAACCCCGACTGCAAGTCCATCCTGAAGGCCCTGG
GCACCGGCGCCACCCTGGAGGAGATGATGACCGCCTGCCAGGGCGTGGGCGGCCCCTCCCACAAGGCCCGCGTGCTGGCCGAGGCCATGTCC
CAGGCCCAGCACGCCAACATCATGATGCAGCGCGGCAACTTCAAGGGCCAGAAGCGCATCAAGTGCTTCAACTGCGGCAAGGAGGGCCACCT
GGCCCGCAACTGCCGCGCCCCCCGCAAGAAGGGCTGCTGGAAGTGCGGCAAGGAGGGCCACCAGATGAAGGACTGCACCGAGCGCCAGGCCA
ACTTCCTGGGCAAGATCTGGCCCTCCAACAAGGGCCGCCCCGGCAACTTCCCCCAGTCCCGCCCCGAGCCCACCGCCCCCCCCGCCGAGAAC
TGGGGCATGGGCGAGGAGATCACCTCCCTGCCCAAGCAGGAGCAGAAGGACAAGGAGCACCCCCCCCCCCTGGTGTCCCTGAAGTCCCTGTT
CGGCAACGACCCCCTGTCCCAGTAA

Fig. 75A

16. 2003_CON_02_AG gag.PEP

MGARASVLSGGKLDAWEKIRLRPGGKKKYRLKHLVWASRELERFALNPGLLETAEGCQQIMEQLQSALRTGSEELKSLYNTVATLWCVHQRI
DIKDTKEALDKIEEVQNKSKQKTQQAAAATGSSSQNYPIVQNAQGQMTHQSMSPRTLNAWVKVIEEKAFSPEVIPMFSALSEGATPQDLNMM
LNIVGGHQAAMQMLKDTINEEAAEWDRVHPVHAGPIPPGQMREPRGSDIAGTTSTLQEQIGWMTSNPPIPVGEIYKRWIVLGLNKIVRMYSP
VSILDIRQGPKEPFRDYVDRFFKTLRAEQATQEVKNWMTETLLVQNANPDCKSILRALGPGATLEEMMTACQGVGGPGHKARVLAEAMSQVQ
QSNIMMQRGNFRGQRTIKCFNCGKEGHLARNCKAPRKKGCWKCGKEGHQMKDCTERQANFLGKIWPSSKGRPGNFPQSRPEPTAPPAESFGM
GEEITSSPKQEPRDKGLYPPLTSLKSLFGNDP$

Fig. 75B

2003_CON_02_AG gag.OPT

ATGGGCGCCCGCGCCTCCGTGCTGTCCGGCGGCAAGCTGGACGCCTGGGAGAAGATCCGCCTGCGCCCCGGCGGCAAGAAGAAGTACCGCCT
GAAGCACCTGGTGTGGGCCTCCCGCGAGCTGGAGCGCTTCGCCCTGAACCCCGGCCTGCTGGAGACCGCCGAGGGCTGCCAGCAGATCATGG
AGCAGCTGCAGTCCGCCCTGCGCACCGGCTCCGAGGAGCTGAAGTCCCTGTACAACACCGTGGCCACCCTGTGGTGCGTGCACCAGCGCATC
GACATCAAGGACACCAAGGAGGCCCTGGACAAGATCGAGGAGGTGCAGAACAAGTCCAAGCAGAAGACCCAGCAGGCCGCCGCCGCCACCGG
CTCCTCCTCCCAGAACTACCCCATCGTGCAGAACGCCCAGGGCCAGATGACCCACCAGTCCATGTCCCCCCGCACCCTGAACGCCTGGGTGA
AGGTGATCGAGGAGAAGGCCTTCTCCCCCGAGGTGATCCCCATGTTCTCCGCCCTGTCCGAGGGCGCCACCCCCCAGGACCTGAACATGATG
CTGAACATCGTGGGCGGCCACCAGGCCGCCATGCAGATGCTGAAGGACACCATCAACGAGGAGGCCGCCGAGTGGGACCGCGTGCACCCCGT
GCACGCCGGCCCCATCCCCCCCGGCCAGATGCGCGAGCCCCGCGGCTCCGACATCGCCGGCACCACCTCCACCCTGCAGGAGCAGATCGGCT
GGATGACCTCCAACCCCCCCATCCCCGTGGGCGAGATCTACAAGCGCTGGATCGTGCTGGGCCTGAACAAGATCGTGCGCATGTACTCCCCC
GTGTCCATCCTGGACATCCGCCAGGGCCCCAAGGAGCCCTTCCGCGACTACGTGGACCGCTTCTTCAAGACCCTGCGCGCCGAGCAGGCCAC
CCAGGAGGTGAAGAACTGGATGACCGAGACCCTGCTGGTGCAGAACGCCAACCCCGACTGCAAGTCCATCCTGCGCGCCCTGGGCCCCGGCG
CCACCCTGGAGGAGATGATGACCGCCTGCCAGGGCGTGGGCGGCCCCGGCCACAAGGCCCGCGTGCTGGCCGAGGCCATGTCCCAGGTGCAG
CAGTCCAACATCATGATGCAGCGCGGCAACTTCCGCGGCCAGCGCACCATCAAGTGCTTCAACTGCGGCAAGGAGGGCCACCTGGCCCGCAA
CTGCAAGGCCCCCCGCAAGAAGGGCTGCTGGAAGTGCGGCAAGGAGGGCCACCAGATGAAGGACTGCACCGAGCGCCAGGCCAACTTCCTGG
GCAAGATCTGGCCCTCCTCCAAGGGCCGCCCCGGCAACTTCCCCCAGTCCCGCCCCGAGCCCACCGCCCCCCCCGCCGAGTCCTTCGGCATG
GGCGAGGAGATCACCTCCTCCCCCAAGCAGGAGCCCCGCGACAAGGGCCTGTACCCCCCCCTGACCTCCCTGAAGTCCCTGTTCGGCAACGA
CCCCTAA

Fig. 76A

17. 2003_CON_03_ABG gag.PEP

MGARASVLSGGKLDAWEKIRLRPGGKKKYRIKHLVWASRELERFALNPSLLETSEGCQQILEQLQPTLKTGSEELKSLYNTVATLYCVHQRI
EIKDTKEALDKIEEIQNKSKQKTQQAATGTGSSSKVSQNYPIVQNAQGQMTHQSMSPRTLNAWVKVIEEKAFSPEVIPMFSALSEGATPQDL
NMMLNIVGGHQAAMQMLKDTINEEAAEWDRLHPAQAGPFPPGQMREPRGSDIAGTTSTLQEQIGWMTSNPPIPVGDIYKRWIILGLNKIVRM
YSPVSILDIRQGPKEPFRDYVDRFFKTLRAEQATQDVKNWMTETLLVQNANPDCKTILRALGSGATLEEMMTACQGVGGPGHKARVLAEAMS
QVQNANIMMQKSNFRGPKRIKCFNCGKDGHLARNCRAPRKKGCWKCGKEGHQMKDCTERQANFLGRIWPSSKGRPGNFPQSRPEPSAPPAEN
FGMGEEITPSLKQEQKDREQHPPSISLKSLFGNDPLSQ$

Fig. 76B

2003_CON_03_ABG gag.OPT

ATGGGCGCCCGCGCCTCCGTGCTGTCCGGCGGCAAGCTGGACGCCTGGGAGAAGATCCGCCTGCGCCCCGGCGGCAAGAAGAAGTACCGCAT
CAAGCACCTGGTGTGGGCCTCCCGCGAGCTGGAGCGCTTCGCCCTGAACCCCTCCCTGCTGGAGACCTCCGAGGGCTGCCAGCAGATCCTGG
AGCAGCTGCAGCCCACCCTGAAGACCGGCTCCGAGGAGCTGAAGTCCCTGTACAACACCGTGGCCACCCTGTACTGCGTGCACCAGCGCATC
GAGATCAAGGACACCAAGGAGGCCCTGGACAAGATCGAGGAGATCCAGAACAAGTCCAAGCAGAAGACCCAGCAGGCCGCCACCGGCACCGG
CTCCTCCTCCAAGGTGTCCCAGAACTACCCCATCGTGCAGAACGCCCAGGGCCAGATGACCCACCAGTCCATGTCCCCCCGCACCCTGAACG
CCTGGGTGAAGGTGATCGAGGAGAAGGCCTTCTCCCCCGAGGTGATCCCCATGTTCTCCGCCCTGTCCGAGGGCGCCACCCCCCAGGACCTG
AACATGATGCTGAACATCGTGGGCGGCCACCAGGCCGCCATGCAGATGCTGAAGGACACCATCAACGAGGAGGCCGCCGAGTGGGACCGCCT
GCACCCCGCCCAGGCCGGCCCCTTCCCCCCGGCCAGATGCGCGAGCCCCGCGGCTCCGACATCGCCGGCACCACCTCCACCCTGCAGGAGC
AGATCGGCTGGATGACCTCCAACCCCCCCATCCCCGTGGGCGACATCTACAAGCGCTGGATCATCCTGGGCCTGAACAAGATCGTGCGCATG
TACTCCCCCGTGTCCATCCTGGACATCCGCCAGGGCCCCAAGGAGCCCTTCCGCGACTACGTGGACCGCTTCTTCAAGACCCTGCGCGCCGA
GCAGGCCACCCAGGACGTGAAGAACTGGATGACCGAGACCCTGCTGGTGCAGAACGCCAACCCCGACTGCAAGACCATCCTGCGCGCCCTGG
GCTCCGGCGCCACCCTGGAGGAGATGATGACCGCCTGCCAGGGCGTGGGCGGCCCCGGCCACAAGGCCCGCGTGCTGGCCGAGGCCATGTCC
CAGGTGCAGAACGCCAACATCATGATGCAGAAGTCCAACTTCCGCGGCCCCAAGCGCATCAAGTGCTTCAACTGCGGCAAGGACGGCCACCT
GGCCCGCAACTGCCGCGCCCCCCGCAAGAAGGGCTGCTGGAAGTGCGGCAAGGAGGGCCACCAGATGAAGGACTGCACCGAGCGCCAGGCCA
ACTTCCTGGGCCGCATCTGGCCCTCCTCCAAGGGCCGCCCCGGCAACTTCCCCCAGTCCCGCCCCGAGCCCTCCGCCCCCCCCGCCGAGAAC
TTCGGCATGGGCGAGGAGATCACCCCCTCCCTGAAGCAGGAGCAGAAGGACCGCGAGCAGCACCCCCCCTCCATCTCCCTGAAGTCCCTGTT
CGGCAACGACCCCCTGTCCCAGTAA

Fig. 77A

18. 2003_CON_04_CFX gag.PEP

MGARASVLSGGKLDAWERIRLRPGGKKKYRLKHLVWASRELERFALNPGLLETAEGCQQLMEQLQSTLKTGSEELKSLFNTIATLWCVHQRI
DVKDTKEALDKVEEMQNKSKQKTQQAAADTGGSSNVSQNYPIVQNAQGQMVHQSISPRTLNAWVKVIEEKAFSPEVIPMFSALSEGATPQDL
NMMLNIVGGHQAAMQMLKDTINEEAAEWDRAHPVHAGPIPPGQMREPRGSDIAGTTSTLQEQIGWMTSNPPIPVGEIYKRWIILGLNKIVRM
YSPVSILDIRQGPKEPFRDYVDRFFKCLRAEQATQEVKNWMTETLLVQNANPDCKSILKALGTGATLEEMMTACQGVGGPSHKARVLAEAMS
QASNAAAAIMMQKSNFKGQRRIIKCFNCGKEGHLARNCRAPRKKGCWKCGKEGHQMKDCTERQANFLGRMWPSSKGRPGNFLQSRPEPTAPP
AESLEMKEETTSSPKQEPRDKELYPLTSLKSLFGSDPLSQ$

Fig. 77B

2003 CON_04_CFX gag.OPT

ATGGGCGCCCGCGCCTCCGTGCTGTCCGGCGGCAAGCTGGACGCCTGGGAGCGCATCCGCCTGCGCCCCGGCGGCAAGAAGAAGTACCGCCT
GAAGCACCTGGTGTGGGCCTCCCGCGAGCTGGAGCGCTTCGCCCTGAACCCCGGCCTGCTGGAGACCGCCGAGGGCTGCCAGCAGCTGATGG
AGCAGCTGCAGTCCACCCTGAAGACCGGCTCCGAGGAGCTGAAGTCCCTGTTCAACACCATCGCCACCCTGTGGTGCGTGCACCAGCGCATC
GACGTGAAGGACACCAAGGAGGCCCTGGACAAGGTGGAGGAGATGCAGAACAAGTCCAAGCAGAAGACCCAGCAGGCCGCCGCCGACACCGG
CGGCTCCTCCAACGTGTCCCAGAACTACCCCATCGTGCAGAACGCCCAGGGCCAGATGGTGCACCAGTCCATCTCCCCCCGCACCCTGAACG
CCTGGGTGAAGGTGATCGAGGAGAAGGCCTTCTCCCCCGAGGTGATCCCCATGTTCTCCGCCCTGTCCGAGGGCGCCACCCCCCAGGACCTG
AACATGATGCTGAACATCGTGGGCGGCCACCAGGCCGCCATGCAGATGCTGAAGGACACCATCAACGAGGAGGCCGCCGAGTGGGACCGCGC
CCACCCCGTGCACGCCGGCCCCATCCCCCCCGGCCAGATGCGCGAGCCCCGCGGCTCCGACATCGCCGGCACCACCTCCACCCTGCAGGAGC
AGATCGGCTGGATGACCTCCAACCCCCCCATCCCCGTGGGCGAGATCTACAAGCGCTGGATCATCCTGGGCCTGAACAAGATCGTGCGCATG
TACTCCCCCGTGTCCATCCTGGACATCCGCCAGGGCCCCAAGGAGCCCTTCCGCGACTACGTGGACCGCTTCTTCAAGTGCCTGCGCGCCGA
GCAGGCCACCCAGGAGGTGAAGAACTGGATGACCGAGACCCTGCTGGTGCAGAACGCCAACCCCGACTGCAAGTCCATCCTGAAGGCCCTGG
GCACCGGCGCCACCCTGGAGGAGATGATGACCGCCTGCCAGGGCGTGGGCGGCCCCTCCCACAAGGCCCGCGTGCTGGCCGAGGCCATGTCC
CAGGCCTCCAACGCCGCCGCCGCCATCATGATGCAGAAGTCCAACTTCAAGGGCCAGCGCCGCATCATCAAGTGCTTCAACTGCGGCAAGGA
GGGCCACCTGGCCCGCAACTGCCGCGCCCCCCGCAAGAAGGGCTGCTGGAAGTGCGGCAAGGAGGGCCACCAGATGAAGGACTGCACCGAGC
GCCAGGCCAACTTCCTGGGCCGCATGTGGCCCTCCTCCAAGGGCCGCCCCGGCAACTTCCTGCAGTCCCGCCCCGAGCCCACCGCCCCCCCC
GCCGAGTCCCTGGAGATGAAGGAGGAGACCACCTCCTCCCCCAAGCAGGAGCCCCGCGACAAGGAGCTGTACCCCCTGACCTCCCTGAAGTC
CCTGTTCGGCTCCGACCCCCTGTCCCAGTAA

Fig. 78A

19. 2003_CON_06_CPX gag.PEP

MGARASVLSGGKLDEWEKIRLRPGGKKKYRLKHLVWASRELERFALNPGLLETAEGCQQIIEQLQSALKTGSEELKSLYNTVATLYCVHQRI
KVTDTKEALDKIEEIQNKSKQKAQQAAAATGNSSNLSQNYPIVQNAQGQMVHQAISPRTLNAWVKVIEEKAFSPEVIPMFSALSEGATPQDL
NMMLNIVGGHQAAMQMLKDTINEEAAEWDRVHPVHAGPIPPGQMREPRGSDIAGTTSTLQEQIGWMTSNPPIPVGEIYKRWIILGLNKIVRM
YSPVSILDIRQGPKEPFRDYVDRFFKTLRAEQATQEVKNWMTDTLLVQNANPDCKTILKALGPGATLEEMMTACQGVGGPGHKARVLAEAMS
QASGTEAAIMMQKSNFKGPKRSIKCFNCGKEGHLARNCRAPRKKGCWKCGKEGHQMKDCTERQANFLGKIWPSNKGRPGNFLQNRPEPTAPP
AESFGFGEETAPSPKQEPKEKELYPLASLKSLFGNDP$

Fig. 78B

2003_CON_06_CPX gag.OPT

ATGGGCGCCCGCGCCTCCGTGCTGTCCGGCGGCAAGCTGGACGAGTGGGAGAAGATCCGCCTGCGCCCCGGCGGCAAGAAGAAGTACCGCCT
GAAGCACCTGGTGTGGGCCTCCCGCGAGCTGGAGCGCTTCGCCCTGAACCCCGGCCTGCTGGAGACCGCCGAGGGCTGCCAGCAGATCATCG
AGCAGCTGCAGTCCGCCCTGAAGACCGGCTCCGAGGAGCTGAAGTCCCTGTACAACACCGTGGCCACCCTGTACTGCGTGCACCAGCGCATC
AAGGTGACCGACACCAAGGAGGCCCTGGACAAGATCGAGGAGATCCAGAACAAGTCCAAGCAGAAGGCCCAGCAGGCCGCCGCCGCCACCGG
CAACTCCTCCAACCTGTCCCAGAACTACCCCATCGTGCAGAACGCCCAGGGCCAGATGGTGCACCAGGCCATCTCCCCCCGCACCCTGAACG
CCTGGGTGAAGGTGATCGAGGAGAAGGCCTTCTCCCCCGAGGTGATCCCCATGTTCTCCGCCCTGTCCGAGGGCGCCACCCCCCAGGACCTG
AACATGATGCTGAACATCGTGGGCGGCCACCAGGCCGCCATGCAGATGCTGAAGGACACCATCAACGAGGAGGCCGCCGAGTGGGACCGCGT
GCACCCCGTGCACGCCGGCCCCATCCCCCCCGGCCAGATGCGCGAGCCCCGCGGCTCCGACATCGCCGGCACCACCTCCACCCTGCAGGAGC
AGATCGGCTGGATGACCTCCAACCCCCCCATCCCCGTGGGCGAGATCTACAAGCGCTGGATCATCCTGGGCCTGAACAAGATCGTGCGCATG
TACTCCCCCGTGTCCATCCTGGACATCCGCCAGGGCCCCAAGGAGCCCTTCCGCGACTACGTGGACCGCTTCTTCAAGACCCTGCGCGCCGA
GCAGGCCACCCAGGAGGTGAAGAACTGGATGACCGACACCCTGCTGGTGCAGAACGCCAACCCCGACTGCAAGACCATCCTGAAGGCCCTGG
GCCCCGGCGCCACCCTGGAGGAGATGATGACCGCCTGCCAGGGCGTGGGCGGCCCCGGCCACAAGGCCCGCGTGCTGGCCGAGGCCATGTCC
CAGGCCTCCGGCACCGAGGCCGCCATCATGATGCAGAAGTCCAACTTCAAGGGCCCCAAGCGCTCCATCAAGTGCTTCAACTGCGGCAAGGA
GGGCCACCTGGCCCGCAACTGCCGCGCCCCCCGCAAGAAGGGCTGCTGGAAGTGCGGCAAGGAGGGCCACCAGATGAAGGACTGCACCGAGC
GCCAGGCCAACTTCCTGGGCAAGATCTGGCCCTCCAACAAGGGCCGCCCCGGCAACTTCCTGCAGAACCGCCCCGAGCCCACCGCCCCCCCC
GCCGAGTCCTTCGGCTTCGGCGAGGAGACCGCCCCCTCCCCCAAGCAGGAGCCCAAGGAGAAGGAGCTGTACCCCCTGGCCTCCCTGAAGTC
CCTGTTCGGCAACGACCCCTAA

*Fig. 79A*

20. 2003_CON_07_BC gag.PEP

MGARASILRGGKLDKWEKIRLRPGGKKHYMLKHLVWASRELERFALNPGLLETSEGCKQIIKQLQPALQTGTEELRSLFNTVATLYCVHTEI
DVRDTKEALDKIEEEQNKIQQKTQQAKEADGKVSQNYPIVQNLQGQMVHQPISPRTLNAWVKVVEEKAFSPEVIPMFSALSEGATPQDLNTM
LNTVGGHQAAMQILKDTINEEAAEWDRLHPVHAGPIAPGQMREPRGSDIAGTTSNLQEQIAWMTSNPPVPVGDIYKRWIILGLNKIVRMYSP
TSILDIKQGPKEPFRDYVDRFFKTLRAEQATQDVKNWMTDTLLVQNANPDCKTILRALGPGASIEEMMTACQGVGGPSHKARVLAEAMSQTN
STILMQRSNFKGSKRIVKCFNCGKEGHIARNCRAPRKKGCWKCGKEGHQMKDCTERQANFLGKIWPSHKGRPGNFLQSRPEPTAPPEESFRF
GEETTTPSQKQEPIDKELYPLTSLKSLFGNDPSSQ$

*Fig. 79B*

2003_CON_07_BC gag.OPT

ATGGGCGCCCGCGCCTCCATCCTGCGCGGCGGCAAGCTGGACAAGTGGGAGAAGATCCGCCTGCGCCCCGGCGGCAAGAAGCACTACATGCT
GAAGCACCTGGTGTGGGCCTCCCGCGAGCTGGAGCGCTTCGCCCTGAACCCCGGCCTGCTGGAGACCTCCGAGGGCTGCAAGCAGATCATCA
AGCAGCTGCAGCCCGCCCTGCAGACCGGCACCGAGGAGCTGCGCTCCCTGTTCAACACCGTGGCCACCCTGTACTGCGTGCACACCGAGATC
GACGTGCGCGACACCAAGGAGGCCCTGGACAAGATCGAGGAGGAGCAGAACAAGATCCAGCAGAAGACCCAGCAGGCCAAGGAGGCCGACGG
CAAGGTGTCCCAGAACTACCCCATCGTGCAGAACCTGCAGGGCCAGATGGTGCACCAGCCCATCTCCCCCCGCACCCTGAACGCCTGGGTGA
AGGTGGTGGAGGAGAAGGCCTTCTCCCCCGAGGTGATCCCCATGTTCTCCGCCCTGTCCGAGGGCGCCACCCCCCAGGACCTGAACACCATG
CTGAACACCGTGGGCGGCCACCAGGCCGCCATGCAGATCCTGAAGGACACCATCAACGAGGAGGCCGCCGAGTGGGACCGCCTGCACCCCGT
GCACGCCGGCCCCATCGCCCCCGGCCAGATGCGCGAGCCCCGCGGCTCCGACATCGCCGGCACCACCTCCAACCTGCAGGAGCAGATCGCCT
GGATGACCTCCAACCCCCCCGTGCCCGTGGGCGACATCTACAAGCGCTGGATCATCCTGGGCCTGAACAAGATCGTGCGCATGTACTCCCCC
ACCTCCATCCTGGACATCAAGCAGGGCCCCAAGGAGCCCTTCCGCGACTACGTGGACCGCTTCTTCAAGACCCTGCGCGCCGAGCAGGCCAC
CCAGGACGTGAAGAACTGGATGACCGACACCCTGCTGGTGCAGAACGCCAACCCCGACTGCAAGACCATCCTGCGCGCCCTGGGCCCCGGCG
CCTCCATCGAGGAGATGATGACCGCCTGCCAGGGCGTGGGCGGCCCCTCCCACAAGGCCCGCGTGCTGGCCGAGGCCATGTCCCAGACCAAC
TCCACCATCCTGATGCAGCGCTCCAACTTCAAGGGCTCCAAGCGCATCGTGAAGTGCTTCAACTGCGGCAAGGAGGGCCACATCGCCCGCAA
CTGCCGCGCCCCCCGCAAGAAGGGCTGCTGGAAGTGCGGCAAGGAGGGCCACCAGATGAAGGACTGCACCGAGCGCCAGGCCAACTTCCTGG
GCAAGATCTGGCCCTCCCACAAGGGCCGCCCCGGCAACTTCCTGCAGTCCCGCCCCGAGCCCACCGCCCCCCCCGAGGAGTCCTTCCGCTTC
GGCGAGGAGACCACCACCCCCTCCCAGAAGCAGGAGCCCATCGACAAGGAGCTGTACCCCCTGACCTCCCTGAAGTCCCTGTTCGGCAACGA
CCCCTCCTCCCAGTAA

Fig. 80A

21. 2003_CON_08_BC gag.PEP

MGARASILRGGKLDKWEKIRLRPGGKKHYMLKHLVWASRELERFALNPGLLETSEGCKQIIKQLQPALQTGTEELRSLFNTVATLYCVHAEI
EVRDTKEALDKIEEEQNKIQQKTQQAKEADEKVSQNYPIVQNLQGQMVHQPLSPRTLNAWVKVVEEKAFSPEVIPMFTALSEGATPQDLNTM
LNTVGGHQAAMQMLKDTINEEAAEWDRLHPVHAGPVAPGQMREPRGSDIAGTTSTLQEQIGWMTNNPPIPVGEIYKRWIILGLNKIVRMYSP
TSILDIKQGPKEPFRDYVDRFFKTLRAEQATQDVKNWMTDTLLVQNANPDCKTILRALGPGASLEEMMTACQGVGGPSHKARVLAEAMSQTN
NTILMQRSNFKGSKRIVKCFNCGKEGHIAKNCRAPRKKGCWKCGKEGHQMKDCTERQANFLGKIWPSHKGRPGNFLQSRPEPTAPPAESFRF
EETTPAPKQEPKDREPLTSLRSLFGSDPLSQ$

Fig. 80B

2003_CON_08_BC gag.OPT

ATGGGCGCCCGCGCCTCCATCCTGCGCGGCGGCAAGCTGGACAAGTGGGAGAAGATCCGCCTGCGCCCCGGCGGCAAGAAGCACTACATGCT
GAAGCACCTGGTGTGGGCCTCCCGCGAGCTGGAGCGCTTCGCCCTGAACCCCGGCCTGCTGGAGACCTCCGAGGGCTGCAAGCAGATCATCA
AGCAGCTGCAGCCCGCCCTGCAGACCGGCACCGAGGAGCTGCGCTCCCTGTTCAACACCGTGGCCACCCTGTACTGCGTGCACGCCGAGATC
GAGGTGCGCGACACCAAGGAGGCCCTGGACAAGATCGAGGAGGAGCAGAACAAGATCCAGCAGAAGACCCAGCAGGCCAAGGAGGCCGACGA
GAAGGTGTCCCAGAACTACCCCATCGTGCAGAACCTGCAGGGCCAGATGGTGCACCAGCCCCTGTCCCCCCGCACCCTGAACGCCTGGGTGA
AGGTGGTGGAGGAGAAGGCCTTCTCCCCCGAGGTGATCCCCATGTTCACCGCCCTGTCCGAGGGCGCCACCCCCCAGGACCTGAACACCATG
CTGAACACCGTGGGCGGCCACCAGGCCGCCATGCAGATGCTGAAGGACACCATCAACGAGGAGGCCGCCGAGTGGGACCGCCTGCACCCCGT
GCACGCCGGCCCCGTGGCCCCCGGCCAGATGCGCGAGCCCCGCGGCTCCGACATCGCCGGCACCACCTCCACCCTGCAGGAGCAGATCGGCT
GGATGACCAACAACCCCCCCATCCCCGTGGGCGAGATCTACAAGCGCTGGATCATCCTGGGCCTGAACAAGATCGTGCGCATGTACTCCCCC
ACCTCCATCCTGGACATCAAGCAGGGCCCCAAGGAGCCCTTCCGCGACTACGTGGACCGCTTCTTCAAGACCCTGCGCGCCGAGCAGGCCAC
CCAGGACGTGAAGAACTGGATGACCGACACCCTGCTGGTGCAGAACGCCAACCCCGACTGCAAGACCATCCTGCGCGCCCTGGGCCCCGGCG
CCTCCCTGGAGGAGATGATGACCGCCTGCCAGGGCGTGGGCGGCCCCTCCCACAAGGCCCGCGTGCTGGCCGAGGCCATGTCCCAGACCAAC
AACACCATCCTGATGCAGCGCTCCAACTTCAAGGGCTCCAAGCGCATCGTGAAGTGCTTCAACTGCGGCAAGGAGGGCCACATCGCCAAGAA
CTGCCGCGCCCCCCGCAAGAAGGGCTGCTGGAAGTGCGGCAAGGAGGGCCACCAGATGAAGGACTGCACCGAGCGCCAGGCCAACTTCCTGG
GCAAGATCTGGCCCTCCCACAAGGGCCGCCCCGGCAACTTCCTGCAGTCCCGCCCCGAGCCCACCGCCCCCCCCGCCGAGTCCTTCCGCTTC
GAGGAGACCACCCCCGCCCCCAAGCAGGAGCCCAAGGACCGCGAGCCCCTGACCTCCCTGCGCTCCCTGTTCGGCTCCGACCCCCTGTCCCA
GTAA

Fig. 81A

22. 2003_CON_10_CD gag.PEP

MGARASVLSGGKLDEWEKIRLRPGGKKKYRLKHLVWASRELERFALNPGLLETSEGCKQIIGQLQPAIQTGSEEIKSLYNTVATLYCVHERI
KVTDTKEALDKIEEEQTKSKKKAQQATADTGNSSQVSQNYPIVQNLQGQMVHQPLSPRTLNAWVKVIEEKAFSPEVIPMFSALSEGATPQDL
NTMLNTVGGHQAAMQMLKETINEEAAEWDRLHPVQAGPVAPGQIREPRGSDIAGTTSTLQEQIRWMTSNPPIPVGEIYKRWIILGLNKIVRM
YSPVSILDIRQGPKEPFRDYVDRFYKTLRAEQASQDVKNWMTETLLVQNANPDCKTILKALGPAATLEEMMTACQGVGGPSHKARVLAEAMS
QATSGNAIMMQRGNFKGPKKIIKCFNCGKEGHIAKNCRAPRKKGCWKCGREGHQMKDCTERQANFLGKIWPSNKGRPGNFLQSRPEPTAPPA
ESFGFGEEITPSQKQEQKDKELHPLASLKSLFGNDPLSQ$

Fig. 81B

2003_CON_10_CD gag.OPT

ATGGGCGCCCGCGCCTCCGTGCTGTCCGGCGGCAAGCTGGACGAGTGGGAGAAGATCCGCCTGCGCCCCGGCGGCAAGAAGAAGTACCGCCT
GAAGCACCTGGTGTGGGCCTCCCGCGAGCTGGAGCGCTTCGCCCTGAACCCCGGCCTGCTGGAGACCTCCGAGGGCTGCAAGCAGATCATCG
GCCAGCTGCAGCCCGCCATCCAGACCGGCTCCGAGGAGATCAAGTCCCTGTACAACACCGTGGCCACCCTGTACTGCGTGCACGAGCGCATC
AAGGTGACCGACACCAAGGAGGCCCTGGACAAGATCGAGGAGGAGCAGACCAAGTCCAAGAAGAAGGCCCAGCAGGCCACCGCCGACACCGG
CAACTCCTCCCAGGTGTCCCAGAACTACCCCATCGTGCAGAACCTGCAGGGCCAGATGGTGCACCAGCCCCTGTCCCCCCGCACCCTGAACG
CCTGGGTGAAGGTGATCGAGGAGAAGGCCTTCTCCCCCGAGGTGATCCCCATGTTCTCCGCCCTGTCCGAGGGCGCCACCCCCCAGGACCTG
AACACCATGCTGAACACCGTGGGCGGCCACCAGGCCGCCATGCAGATGCTGAAGGAGACCATCAACGAGGAGGCCGCCGAGTGGGACCGCCT
GCACCCCGTGCAGGCCGGCCCCGTGGCCCCCGGCCAGATCCGCGAGCCCCGCGGCTCCGACATCGCCGGCACCACCTCCACCCTGCAGGAGC
AGATCCGCTGGATGACCTCCAACCCCCCCATCCCCGTGGGCGAGATCTACAAGCGCTGGATCATCCTGGGCCTGAACAAGATCGTGCGCATG
TACTCCCCCGTGTCCATCCTGGACATCCGCCAGGGCCCCAAGGAGCCCTTCCGCGACTACGTGGACCGCTTCTACAAGACCCTGCGCGCCGA
GCAGGCCTCCCAGGACGTGAAGAACTGGATGACCGAGACCCTGCTGGTGCAGAACGCCAACCCCGACTGCAAGACCATCCTGAAGGCCCTGG
GCCCCGCCGCCACCCTGGAGGAGATGATGACCGCCTGCCAGGGCGTGGGCGGCCCCTCCCACAAGGCCCGCGTGCTGGCCGAGGCCATGTCC
CAGGCCACCTCCGGCAACGCCATCATGATGCAGCGCGGCAACTTCAAGGGCCCCAAGAAGATCATCAAGTGCTTCAACTGCGGCAAGGAGGG
CCACATCGCCAAGAACTGCCGCGCCCCCCGCAAGAAGGGCTGCTGGAAGTGCGGCCGCGAGGGCCACCAGATGAAGGACTGCACCGAGCGCC
AGGCCAACTTCCTGGGCAAGATCTGGCCCTCCAACAAGGGCCGCCCCGGCAACTTCCTGCAGTCCCGCCCCGAGCCCACCGCCCCCCCCGCC
GAGTCCTTCGGCTTCGGCGAGGAGATCACCCCCTCCCAGAAGCAGGAGCAGAAGGACAAGGAGCTGCACCCCCTGGCCTCCCTGAAGTCCCT
GTTCGGCAACGACCCCCTGTCCCAGTAA

Fig. 82A

23. 2003_CON_11_CPX gag.PEP gag.PEPMGARASVLSGGKLDAWEKIRLRPGGKKKYRLKHLVWASRELERFALNPSLLETAEGCQQIMGQLQPALGTGTEELRSLYNTVATL
YCVHHRIEVKDTKEALDKIEEIQNKSKQKKQQAAADTGNSSKVSQNYPIVQNAQGQMVHQAISPRTLNAWVKVVEEKAFSPEVIPMFSALSE
GATPQDLNMMLNIVGGHQAAMQMLKDTINEEAAEWDRVHPVHAGPIPPGQMREPRGSDIAGTTSTLQEQIGWMTGNPPVPVGEIYRRWIILG
LNKIVRMYSPVSILDIRQGPKEPFRDYVDRFFKTLRAEQATQEVKSWMTETLLIQNANPDCKSILRALGPGATLEEMMTACQGVGGPGHKAR
VLAEAMSQVQQTNIMMQRSNFKGQKRIKCFNCGKEGHLARNCRAPRKKGCWKCGKEGHQMKDCTERQANFLGKIWPSSKGRPGNFLQSRPEP
TAPPAESFGFGEEIAPSPKQEPKEKELYPLTSLKSLFGSDPLSQ$

Fig. 82B

2003_CON_11_CPX gag.OPT

ATGGGCGCCCGCGCCTCCGTGCTGTCCGGCGGCAAGCTGGACGCCTGGGAGAAGATCCGCCTGCGCCCCGGCGGCAAGAAGAAGTACCGCCT
GAAGCACCTGGTGTGGGCCTCCCGCGAGCTGGAGCGCTTCGCCCTGAACCCCTCCCTGCTGGAGACCGCCGAGGGCTGCCAGCAGATCATGG
GCCAGCTGCAGCCCGCCCTGGGCACCGGCACCGAGGAGCTGCGCTCCCTGTACAACACCGTGGCCACCCTGTACTGCGTGCACCACCGCATC
GAGGTGAAGGACACCAAGGAGGCCCTGGACAAGATCGAGGAGATCCAGAACAAGTCCAAGCAGAAGAAGCAGCAGGCCGCCGCCGACACCGG
CAACTCCTCCAAGGTGTCCCAGAACTACCCCATCGTGCAGAACGCCCAGGGCCAGATGGTGCACCAGGCCATCTCCCCCCGCACCCTGAACG
CCTGGGTGAAGGTGGTGGAGGAGAAGGCCTTCTCCCCCGAGGTGATCCCCATGTTCTCCGCCCTGTCCGAGGGCGCCACCCCCCAGGACCTG
AACATGATGCTGAACATCGTGGGCGGCCACCAGGCCGCCATGCAGATGCTGAAGGACACCATCAACGAGGAGGCCGCCGAGTGGGACCGCGT
GCACCCCGTGCACGCCGGCCCCATCCCCCCCGGCCAGATGCGCGAGCCCCGCGGCTCCGACATCGCCGGCACCACCTCCACCCTGCAGGAGC
AGATCGGCTGGATGACCGGCAACCCCCCCGTGCCCGTGGGCGAGATCTACCGCCGCTGGATCATCCTGGGCCTGAACAAGATCGTGCGCATG
TACTCCCCCGTGTCCATCCTGGACATCCGCCAGGGCCCCAAGGAGCCCTTCCGCGACTACGTGGACCGCTTCTTCAAGACCCTGCGCGCCGA
GCAGGCCACCCAGGAGGTGAAGTCCTGGATGACCGAGACCCTGCTGATCCAGAACGCCAACCCCGACTGCAAGTCCATCCTGCGCGCCCTGG
GCCCCGGCGCCACCCTGGAGGAGATGATGACCGCCTGCCAGGGCGTGGGCGGCCCCGGCCACAAGGCCCGCGTGCTGGCCGAGGCCATGTCC
CAGGTGCAGCAGACCAACATCATGATGCAGCGCTCCAACTTCAAGGGCCAGAAGCGCATCAAGTGCTTCAACTGCGGCAAGGAGGGCCACCT
GGCCCGCAACTGCCGCGCCCCCCGCAAGAAGGGCTGCTGGAAGTGCGGCAAGGAGGGCCACCAGATGAAGGACTGCACCGAGCGCCAGGCCA
ACTTCCTGGGCAAGATCTGGCCCTCCTCCAAGGGCCGCCCCGGCAACTTCCTGCAGTCCCGCCCCGAGCCCACCGCCCCCCCCGCCGAGTCC
TTCGGCTTCGGCGAGGAGATCGCCCCCTCCCCCAAGCAGGAGCCCAAGGAGAAGGAGCTGTACCCCCTGACCTCCCTGAAGTCCCTGTTCGG
CTCCGACCCCCTGTCCCAGTAA

*Fig. 83A*

24. 2003_CON_12_BF.gag.PEP
MGARASVLSGGELDRWEKIRLRPGGKKKYRLKHIVWASRELERFAVNPGLLETSEGCRKIIGQLQPSLQTGSEELRSLYNTIAVLYFVHQKV
EVKDTKEALDKLEEEQNKSQQKTQQAAADKGVSQNYPIVQNLQGQMVHQALSPRTLNAWVKVVEEKAFSPEVIPMFSALSEGATPQDLNTML
NTVGGHQAAMQMLKDTINEEAAEWDRLHPVHAGPIPPGQMREPRGSDIAGTTSTLQEQIQWMTSNPPVPVGEIYKRWIILGLNKIVRMYSPV
SILDIRQGPKEPFRDYVDRFFKTLRAEQATQEVKGWMTDTLLVQNANPDCKTILKALGPGATLEEMMTACQGVGGPGHKARVLAEAMSQVTN
TTVMMQKSNFKGQRRIVKCFNCGKEGHIAKNCRAPRKKGCWKCGREGHQMKDCTERQANFLGKIWPSNKGRPGNFLQNRPEPTAPPAESFGF
GEEITPSPKQEQKDEGLYPPLASLKSLFGNDP$

*Fig. 83B*

2003_CON_12_BF.gag.OPT
ATGGGCGCCCGCGCCTCCGTGCTGTCCGGCGGCGAGCTGGACCGCTGGGAGAAGATCCGCCTGCGCCCCGGCGGCAAGAAGAAGTACCGCCT
GAAGCACATCGTGTGGGCCTCCCGCGAGCTGGAGCGCTTCGCCGTGAACCCCGGCCTGCTGGAGACCTCCGAGGGCTGCCGCAAGATCATCG
GCCAGCTGCAGCCCTCCCTGCAGACCGGCTCCGAGGAGCTGCGCTCCCTGTACAACACCATCGCCGTGCTGTACTTCGTGCACCAGAAGGTG
GAGGTGAAGGACACCAAGGAGGCCCTGGACAAGCTGGAGGAGGAGCAGAACAAGTCCCAGCAGAAGACCCAGCAGGCCGCCGCCGACAAGGG
CGTGTCCCAGAACTACCCCATCGTGCAGAACCTGCAGGGCCAGATGGTGCACCAGGCCCTGTCCCCCCGCACCCTGAACGCCTGGGTGAAGG
TGGTGGAGGAGAAGGCCTTCTCCCCCGAGGTGATCCCCATGTTCTCCGCCCTGTCCGAGGGCGCCACCCCCCAGGACCTGAACACCATGCTG
AACACCGTGGGCGGCCACCAGGCCGCCATGCAGATGCTGAAGGACACCATCAACGAGGAGGCCGCCGAGTGGGACCGCCTGCACCCCGTGCA
CGCCGGCCCCATCCCCCCCGGCCAGATGCGCGAGCCCCGCGGCTCCGACATCGCCGGCACCACCTCCACCCTGCAGGAGCAGATCCAGTGGA
TGACCTCCAACCCCCCCGTGCCCGTGGGCGAGATCTACAAGCGCTGGATCATCCTGGGCCTGAACAAGATCGTGCGCATGTACTCCCCCGTG
TCCATCCTGGACATCCGCCAGGGCCCCAAGGAGCCCTTCCGCGACTACGTGGACCGCTTCTTCAAGACCCTGCGCGCCGAGCAGGCCACCCA
GGAGGTGAAGGGCTGGATGACCGACACCCTGCTGGTGCAGAACGCCAACCCCGACTGCAAGACCATCCTGAAGGCCCTGGGCCCCGGCGCCA
CCCTGGAGGAGATGATGACCGCCTGCCAGGGCGTGGGCGGCCCCGGCCACAAGGCCCGCGTGCTGGCCGAGGCCATGTCCCAGGTGACCAAC
ACCACCGTGATGATGCAGAAGTCCAACTTCAAGGGCCAGCGCCGCATCGTGAAGTGCTTCAACTGCGGCAAGGAGGGCCACATCGCCAAGAA
CTGCCGCGCCCCCCGCAAGAAGGGCTGCTGGAAGTGCGGCCGCGAGGGCCACCAGATGAAGGACTGCACCGAGCGCCAGGCCAACTTCCTGG
GCAAGATCTGGCCCTCCAACAAGGGCCGCCCCGGCAACTTCCTGCAGAACCGCCCCGAGCCCACCGCCCCCCCCGCCGAGTCCTTCGGCTTC
GGCGAGGAGATCACCCCCTCCCCCAAGCAGGAGCAGAAGGACGAGGGCCTGTACCCCCCCCTGGCCTCCCTGAAGTCCCTGTTCGGCAACGA
CCCCTAA

Fig. 84A

25. 2003_CON_14_BG gag.PEP

MGARASVLSGGKLDAWEKIRLRPGGKKKYRMKHLVWASRELERFALNPDLLETAEGCQQIMGQLQPALQTGTEEIRSLFNTVATLYCVHQKI
EVKDTKEALEEVEKAQKKSQKKQQAAMDEGNNSQASQNYPIVQNAQGQMVHQAISPRTLNAWVKVVEEKAFSPEVIPMFSALSEGATPQDLN
TMLNTVGGHQAAMQMLKDTINEEAAEWDRMHPQQAGPIPPGQIREPRGSDIAGTTSTLQEQIRWMTSNPPIPVGEIYKRWIILGLNKIVRMY
SPVSILDIRQGPKEPFRDYVDRFFKTLRAEQATQEVKGWMTDTLLVQNANPDCKTILRALGPGATLEEMMTACQGVGGPSHKARVLAEAMSQ
ASGATIMMQKSNFKGPRRNIKCFNCGKEGHLARNCRAPRKKGCWKCGKEGHQMKDCTESKANFLGKIWPSNKGRPGNFLQNRPEPTAPPAES
FGFGEEIAPSPKQEPKEKEIYPLASLKSLFGSDP$SQ$

Fig. 84B

2003_CON_14_BG gag.OPT

ATGGGCGCCCGCGCCTCCGTGCTGTCCGGCGGCAAGCTGGACGCCTGGGAGAAGATCCGCCTGCGCCCCGGCGGCAAGAAGAAGTACCGCAT
GAAGCACCTGGTGTGGGCCTCCCGCGAGCTGGAGCGCTTCGCCCTGAACCCCGACCTGCTGGAGACCGCCGAGGGCTGCCAGCAGATCATGG
GCCAGCTGCAGCCCGCCCTGCAGACCGGCACCGAGGAGATCCGCTCCCTGTTCAACACCGTGGCCACCCTGTACTGCGTGCACCAGAAGATC
GAGGTGAAGGACACCAAGGAGGCCCTGGAGGAGGTGGAGAAGGCCCAGAAGAAGTCCCAGAAGAAGCAGCAGGCCGCCATGGACGAGGGCAA
CAACTCCCAGGCCTCCCAGAACTACCCCATCGTGCAGAACGCCCAGGGCCAGATGGTGCACCAGGCCATCTCCCCCCGCACCCTGAACGCCT
GGGTGAAGGTGGTGGAGGAGAAGGCCTTCTCCCCCGAGGTGATCCCCATGTTCTCCGCCCTGTCCGAGGGCGCCACCCCCCAGGACCTGAAC
ACCATGCTGAACACCGTGGGCGGCCACCAGGCCGCCATGCAGATGCTGAAGGACACCATCAACGAGGAGGCCGCCGAGTGGGACCGCATGCA
CCCCCAGCAGGCCGGCCCCATCCCCCCCGGCCAGATCCGCGAGCCCCGCGGCTCCGACATCGCCGGCACCACCTCCACCCTGCAGGAGCAGA
TCCGCTGGATGACCTCCAACCCCCCCATCCCCGTGGGCGAGATCTACAAGCGCTGGATCATCCTGGGCCTGAACAAGATCGTGCGCATGTAC
TCCCCCGTGTCCATCCTGGACATCCGCCAGGGCCCCAAGGAGCCCTTCCGCGACTACGTGGACCGCTTCTTCAAGACCCTGCGCGCCGAGCA
GGCCACCCAGGAGGTGAAGGGCTGGATGACCGACACCCTGCTGGTGCAGAACGCCAACCCCGACTGCAAGACCATCCTGCGCGCCCTGGGCC
CCGGCGCCACCCTGGAGGAGATGATGACCGCCTGCCAGGGCGTGGGCGGCCCCTCCCACAAGGCCCGCGTGCTGGCCGAGGCCATGTCCCAG
GCCTCCGGCGCCACCATCATGATGCAGAAGTCCAACTTCAAGGGCCCCCGCCGCAACATCAAGTGCTTCAACTGCGGCAAGGAGGGCCACCT
GGCCCGCAACTGCCGCGCCCCCCGCAAGAAGGGCTGCTGGAAGTGCGGCAAGGAGGGCCACCAGATGAAGGACTGCACCGAGTCCAAGGCCA
ACTTCCTGGGCAAGATCTGGCCCTCCAACAAGGGCCGCCCCGGCAACTTCCTGCAGAACCGCCCCGAGCCCACCGCCCCCCCCGCCGAGTCC
TTCGGCTTCGGCGAGGAGATCGCCCCCTCCCCCAAGCAGGAGCCCAAGGAGAAGGAGATCTACCCCCTGGCCTCCCTGAAGTCCCTGTTCGG
CTCCGACCCCTAATCCCAGTAA

Fig. 85A

31. 2003_CONS nef.PEP
MGGKWSKSSIVGWPAVRERIRRTPPAAEGVGAVSQDLDKHGAITSSNTAATNADCAWLEAQEEEEVGFPVRPQVPLRPMTYKGAFDLSHFLK
EKGGLDGLIYSKKRQEILDLWVYHTQGYFPDWQNYTPGPGIRYPLTFGWCFKLVPVDPEEVEEANEGENNCLLHPMCQHGMEDEDREVLMWK
FDSRLALRHIARELHPEFYKDC$

Fig. 85B

2003_CONS nef.OPT
ATGGGCGGCAAGTGGTCCAAGTCCTCCATCGTGGGCTGGCCCGCCGTGCGCGAGCGCATCCGCCGCACCCCCCCCGCCGCCGAGGGCGTGGG
CGCCGTGTCCCAGGACCTGGACAAGCACGGCGCCATCACCTCCTCCAACACCGCCGCCACCAACGCCGACTGCGCCTGGCTGGAGGCCCAGG
AGGAGGAGGAGGTGGGCTTCCCCGTGCGCCCCCAGGTGCCCCTGCGCCCCATGACCTACAAGGGCGCCTTCGACCTGTCCCACTTCCTGAAG
GAGAAGGGCGGCCTGGACGGCCTGATCTACTCCAAGAAGCGCCAGGAGATCCTGGACCTGTGGGTGTACCACACCCAGGGCTACTTCCCCGA
CTGGCAGAACTACACCCCCGGCCCCGGCATCCGCTACCCCCTGACCTTCGGCTGGTGCTTCAAGCTGGTGCCCGTGGACCCCGAGGAGGTGG
AGGAGGCCAACGAGGGCGAGAACAACTGCCTGCTGCACCCCATGTGCCAGCACGGCATGGAGGACGAGGACCGCGAGGTGCTGATGTGGAAG
TTCGACTCCCGCCTGGCCCTGCGCCACATCGCCCGCGAGCTGCACCCCGAGTTCTACAAGGACTGCTAA

Fig. 86A

32. 2003_M. GROUP.anc nef.PEP
MGGKWSKSSIVGWPAVRERMRRTAPAAEGVGAVSQDLDKHGAITSSNTAATNADCAWLEAQEEEEVGFPVRPQVPLRPMTYKAAFDLSHFLK
EKGGLDGLIYSKKRQEILDLWVYHTQGYFPDWQNYTPGPGIRYPLTFGWCFKLVPVDPEEVEEANEGENNCLLHPMCQHGMEDEEREVLMWK
FDSRLALRHIARELHPEFYKDC$

Fig. 86B

2003_M GROUP.anc nef.OPT
ATGGGCGGCAAGTGGTCCAAGTCCTCCATCGTGGGCTGGCCCGCCGTGCGCGAGCGCATGCGCCGCACCGCCCCCGCCGCCGAGGGCGTGGG
CGCCGTGTCCCAGGACCTGGACAAGCACGGCGCCATCACCTCCTCCAACACCGCCGCCACCAACGCCGACTGCGCCTGGCTGGAGGCCCAGG
AGGAGGAGGAGGTGGGCTTCCCCGTGCGCCCCCAGGTGCCCCTGCGCCCCATGACCTACAAGGCCGCCTTCGACCTGTCCCACTTCCTGAAG
GAGAAGGGCGGCCTGGACGGCCTGATCTACTCCAAGAAGCGCCAGGAGATCCTGGACCTGTGGGTGTACCACACCCAGGGCTACTTCCCCGA
CTGGCAGAACTACACCCCCGGCCCCGGCATCCGCTACCCCCTGACCTTCGGCTGGTGCTTCAAGCTGGTGCCCGTGGACCCCGAGGAGGTGG
AGGAGGCCAACGAGGGCGAGAACAACTGCCTGCTGCACCCCATGTGCCAGCACGGCATGGAGGACGAGGAGCGCGAGGTGCTGATGTGGAAG
TTCGACTCCCGCCTGGCCCTGCGCCACATCGCCCGCGAGCTGCACCCCGAGTTCTACAAGGACTGCTAA

Fig. 87A

33. 2003_CON_A nef.PEP

MGGKWSKSSIVGWPDIRERIRRTPPAAKGVGAVSQDLDKYGAVTINNTAATQASCAWLEAQEEEEEVGFPVRPQVPLRPMTFKGAFDLSFFL
KEKGGLDGLIYSQKRQEILDLWVYNTQGYFPDWQNYTPGPGTRFPLTFGWCFKLVPVDPDEVEEATEGENNCLLHPICQHGMDDEEKEVLMW
KFDSRLARRHIALEMHPEFYKDC$

Fig. 87B

2003_CON_A nef.OPT

ATGGGCGGCAAGTGGTCCAAGTCCTCCATCGTGGGCTGGCCCGACATCCGCGAGCGCATCCGCCGCACCCCCCCCGCCGCCAAGGGCGTGGG
CGCCGTGTCCCAGGACCTGGACAAGTACGGCGCCGTGACCATCAACAACACCGCCGCCACCCAGGCCTCCTGCGCCTGGCTGGAGGCCCAGG
AGGAGGAGGAGGAGGTGGGCTTCCCCGTGCGCCCCCAGGTGCCCCTGCGCCCCATGACCTTCAAGGGCGCCTTCGACCTGTCCTTCTTCCTG
AAGGAGAAGGGCGGCCTGGACGGCCTGATCTACTCCCAGAAGCGCCAGGAGATCCTGGACCTGTGGGTGTACAACACCCAGGGCTACTTCCC
CGACTGGCAGAACTACACCCCCGGCCCCGGCACCCGCTTCCCCCTGACCTTCGGCTGGTGCTTCAAGCTGGTGCCCGTGGACCCCGACGAGG
TGGAGGAGGCCACCGAGGGCGAGAACAACTGCCTGCTGCACCCCATCTGCCAGCACGGCATGGACGACGAGGAGAAGGAGGTGCTGATGTGG
AAGTTCGACTCCCGCCTGGCCCGCCGCCACATCGCCCTGGAGATGCACCCCGAGTTCTACAAGGACTGCTAA

Fig. 88A

34. 2003_CON_A1 nef.PEP

MGGKWSKSSIVGWPEVRERMRRTPPAATGVGAVSQDLDKHGAVTSSNINHPSCVWLEAQEEEEVGFPVRPQVPLRPMTYKGALDLSHFLKEK
GGLDGLIYSRKRQEILDLWVYHTQGYFPDWQNYTPGPGIRYPLTFGWCFKLVPVDPDEVEKATEGENNSLLHPICQHGMDDEEREVLKWKFD
SRLALKHRAQELHPEFYKDC$

Fig. 88B

2003_CON_A1 nef.OPT

ATGGGCGGCAAGTGGTCCAAGTCCTCCATCGTGGGCTGGCCCGAGGTGCGCGAGCGCATGCGCCGCACCCCCCCCGCCGCCACCGGCGTGGG
CGCCGTGTCCCAGGACCTGGACAAGCACGGCGCCGTGACCTCCTCCAACATCAACCACCCCTCCTGCGTGTGGCTGGAGGCCCAGGAGGAGG
AGGAGGTGGGCTTCCCCGTGCGCCCCCAGGTGCCCCTGCGCCCCATGACCTACAAGGGCGCCCTGGACCTGTCCCACTTCCTGAAGGAGAAG
GGCGGCCTGGACGGCCTGATCTACTCCCGCAAGCGCCAGGAGATCCTGGACCTGTGGGTGTACCACACCCAGGGCTACTTCCCCGACTGGCA
GAACTACACCCCCGGCCCCGGCATCCGCTACCCCCTGACCTTCGGCTGGTGCTTCAAGCTGGTGCCCGTGGACCCCGACGAGGTGGAGAAGG
CCACCGAGGGCGAGAACAACTCCCTGCTGCACCCCATCTGCCAGCACGGCATGGACGACGAGGAGCGCGAGGTGCTGAAGTGGAAGTTCGAC
TCCCGCCTGGCCCTGAAGCACCGCGCCCAGGAGCTGCACCCCGAGTTCTACAAGGACTGCTAA

Fig. 88C

35. 2003_A1.anc nef.PEP
MGGKWSKSSIVGWPEVRERMRRTPPAAKGVGAVSQDLDKHGAVTSSNTAANNPGCAWLEAQEEEEVGFPVRPQVPLRPMTYKGAFDLSHFLK
EKGGLDGLIYSKKRQEILDLWVYHTQGYFPDWQNYTPGPGIRYPLTFGWCFKLVPVDPAEVEEATEGENNSLLHPICQHGMDDEEREVLMWK
FDSRLALKHRARELHPEFYKDC$

Fig. 88D

2003_A1.anc nef.OPT
ATGGGCGGCAAGTGGTCCAAGTCCTCCATCGTGGGCTGGCCCGAGGTGCGCGAGCGCATGCGCCGCACCCCCCCCGCCGCCAAGGGCGTGGG
CGCCGTGTCCCAGGACCTGGACAAGCACGGCGCCGTGACCTCCTCCAACACCGCCGCCAACAACCCCGGCTGCGCCTGGCTGGAGGCCCAGG
AGGAGGAGGAGGTGGGCTTCCCCGTGCGCCCCCAGGTGCCCCTGCGCCCCATGACCTACAAGGGCGCCTTCGACCTGTCCCACTTCCTGAAG
GAGAAGGGCGGCCTGGACGGCCTGATCTACTCCAAGAAGCGCCAGGAGATCCTGGACCTGTGGGTGTACCACACCCAGGGCTACTTCCCCGA
CTGGCAGAACTACACCCCCGGCCCCGGCATCCGCTACCCCCTGACCTTCGGCTGGTGCTTCAAGCTGGTGCCCGTGGACCCCGCCGAGGTGG
AGGAGGCCACCGAGGGCGAGAACAACTCCCTGCTGCACCCCATCTGCCAGCACGGCATGGACGACGAGGAGCGCGAGGTGCTGATGTGGAAG
TTCGACTCCCGCCTGGCCCTGAAGCACCGCGCCCGCGAGCTGCACCCCGAGTTCTACAAGGACTGCTAA

Fig. 89A

36. 2003_CON_A2 nef.PEP
MGGKWSKSSIVGWPAIRERMRKRTPPAAEGVGAVSQDLATRGAVTSSNTAATNPDCAWLEAQEEEEVGFPVRPQVPLRPMTFKGAFDLSHFL
KEKGGLDGLIYSQKRQDILDLWVYHTQGYFPDWQNYTPGPGTRYPLTFGWCFKLVPVDPSEVEEATEGENNSLLHPICQHGIEDPEREVLRW
KFDSRLALRHRARELHPEFYKDC$

Fig. 89B

2003_CON_A2 nef.OPT
ATGGGCGGCAAGTGGTCCAAGTCCTCCATCGTGGGCTGGCCCGCCATCCGCGAGCGCATGCGCAAGCGCACCCCCCCCGCCGCCGAGGGCGT
GGGCGCCGTGTCCCAGGACCTGGCCACCCGCGGCGCCGTGACCTCCTCCAACACCGCCGCCACCAACCCCGACTGCGCCTGGCTGGAGGCCC
AGGAGGAGGAGGAGGTGGGCTTCCCCGTGCGCCCCCAGGTGCCCCTGCGCCCCATGACCTTCAAGGGCGCCTTCGACCTGTCCCACTTCCTG
AAGGAGAAGGGCGGCCTGGACGGCCTGATCTACTCCCAGAAGCGCCAGGACATCCTGGACCTGTGGGTGTACCACACCCAGGGCTACTTCCC
CGACTGGCAGAACTACACCCCCGGCCCCGGCACCCGCTACCCCCTGACCTTCGGCTGGTGCTTCAAGCTGGTGCCCGTGGACCCCTCCGAGG
TGGAGGAGGCCACCGAGGGCGAGAACAACTCCCTGCTGCACCCCATCTGCCAGCACGGCATCGAGGACCCCGAGCGCGAGGTGCTGCGCTGG
AAGTTCGACTCCCGCCTGGCCCTGCGCCACCGCGCCCGCGAGCTGCACCCCGAGTTCTACAAGGACTGCTAA

Fig. 90A

37. 2003_CON_B nef.PEP
MGGKWSKRSVVGWPTVRERMRRAEPAADGVGAVSRDLEKHGAITSSNTAANNADCAWLEAQEEEEVGFPVRPQVPLRPMTYKGALDLSHFLK
EKGGLEGLIYSQKRQDILDLWVYHTQGYFPDWQNYTPGPGIRYPLTFGWCFKLVPVEPEKVEEANEGENNSLLHPMSLHGMDDPEREVLVWK
FDSRLAFHHMARELHPEYYKDC$

Fig. 90B

2003_CON-B nef.OPT
ATGGGCGGCAAGTGGTCCAAGCGCTCCGTGGTGGGCTGGCCCACCGTGCGCGAGCGCATGCGCCGCGCCGAGCCCGCCGCCGACGGCGTGGG
CGCCGTGTCCCGCGACCTGGAGAAGCACGGCGCCATCACCTCCTCCAACACCGCCGCCAACAACGCCGACTGCGCCTGGCTGGAGGCCCAGG
AGGAGGAGGAGGTGGGCTTCCCCGTGCGCCCCCAGGTGCCCCTGCGCCCCATGACCTACAAGGGCGCCCTGGACCTGTCCCACTTCCTGAAG
GAGAAGGGCGGCCTGGAGGGCCTGATCTACTCCCAGAAGCGCCAGGACATCCTGGACCTGTGGGTGTACCACACCCAGGGCTACTTCCCCGA
CTGGCAGAACTACACCCCCGGCCCCGGCATCCGCTACCCCCTGACCTTCGGCTGGTGCTTCAAGCTGGTGCCCGTGGAGCCCGAGAAGGTGG
AGGAGGCCAACGAGGGCGAGAACAACTCCCTGCTGCACCCCATGTCCCTGCACGGCATGGACGACCCCGAGCGCGAGGTGCTGGTGTGGAAG
TTCGACTCCCGCCTGGCCTTCCACCACATGGCCCGCGAGCTGCACCCCGAGTACTACAAGGACTGCTAA

Fig. 90C

38. 2003_B.anc nef.PEP
MGGKWSKSSMGGWPAVRERMKRAEPAADGVGAVSRDLEKHGAITSSNTAATNADCAWLEAQEEEEVGFPVRPQVPLRPMTYKAALDLSHFLK
EKGGLEGLIYSQKRQDILDLWVYHTQGYFPDWQNYTPGPGIRYPLTFGWCFKLVPVEPEKVEEATEGENNSLLHPMCQHGMDDPEKEVLVWK
FDSRLAFHHMARELHPEYYKDC$

Fig. 90D

2003_B.anc nef.OPT
ATGGGCGGCAAGTGGTCCAAGTCCTCCATGGGCGGCTGGCCCGCCGTGCGCGAGCGCATGAAGCGCGCCGAGCCCGCCGCCGACGGCGTGGG
CGCCGTGTCCCGCGACCTGGAGAAGCACGGCGCCATCACCTCCTCCAACACCGCCGCCACCAACGCCGACTGCGCCTGGCTGGAGGCCCAGG
AGGAGGAGGAGGTGGGCTTCCCCGTGCGCCCCCAGGTGCCCCTGCGCCCCATGACCTACAAGGCCGCCCTGGACCTGTCCCACTTCCTGAAG
GAGAAGGGCGGCCTGGAGGGCCTGATCTACTCCCAGAAGCGCCAGGACATCCTGGACCTGTGGGTGTACCACACCCAGGGCTACTTCCCCGA
CTGGCAGAACTACACCCCCGGCCCCGGCATCCGCTACCCCCTGACCTTCGGCTGGTGCTTCAAGCTGGTGCCCGTGGAGCCCGAGAAGGTGG
AGGAGGCCACCGAGGGCGAGAACAACTCCCTGCTGCACCCCATGTGCCAGCACGGCATGGACGACCCCGAGAAGGAGGTGCTGGTGTGGAAG
TTCGACTCCCGCCTGGCCTTCCACCACATGGCCCGCGAGCTGCACCCCGAGTACTACAAGGACTGCTAA

Fig. 91A

39. 2003_CON_02_AG nef.PEP
MGGKWSKSSIVGWPKVRERIRQTPPAATGVGAASQDLDRHGAITSSNTAATNADCAWLEAQEEEEVGFPVRPQVPLRPMTYKAAVDLSHFLK
EKGGLEGLIYSKKRQEILDLWVYHTQGFFPDWQNYTPGPGTRFPLTFGWCFKLVPMDPAEVEEANEGENNSLLHPICQHGMEDEDREVLVWR
FDSSLAFKHRARELHPEFYKDC$

Fig. 91B

2003_CON_02_AG nef.OPT
ATGGGCGGCAAGTGGTCCAAGTCCTCCATCGTGGGCTGGCCCAAGGTGCGCGAGCGCATCCGCCAGACCCCCCCGCCGCCACCGGCGTGGG
CGCCGCCTCCCAGGACCTGGACCGCCACGGCGCCATCACCTCCTCCAACACCGCCGCCACCAACGCCGACTGCGCCTGGCTGGAGGCCCAGG
AGGAGGAGGAGGTGGGCTTCCCCGTGCGCCCCCAGGTGCCCCTGCGCCCCATGACCTACAAGGCCGCCGTGGACCTGTCCCACTTCCTGAAG
GAGAAGGGCGGCCTGGAGGGCCTGATCTACTCCAAGAAGCGCCAGGAGATCCTGGACCTGTGGGTGTACCACACCCAGGGCTTCTTCCCCGA
CTGGCAGAACTACACCCCCGGCCCCGGCACCCGCTTCCCCCTGACCTTCGGCTGGTGCTTCAAGCTGGTGCCCATGGACCCCGCCGAGGTGG
AGGAGGCCAACGAGGGCGAGAACAACTCCCTGCTGCACCCCATCTGCCAGCACGGCATGGAGGACGAGGACCGCGAGGTGCTGGTGTGGCGC
TTCGACTCCTCCCTGGCCTTCAAGCACCGCGCCCGCGAGCTGCACCCCGAGTTCTACAAGGACTGCTAA

Fig. 92A

40. 2003_CON_C nef.PEP
MGGKWSKSSIVGWPAVRERIRRTEPAAEGVGAASQDLDKHGALTSSNTATNNADCAWLEAQEEEEVGFPVRPQVPLRPMTYKAAFDLSFFL
KEKGGLEGLIYSKKRQEILDLWVYHTQGYFPDWQNYTPGPGVRYPLTFGWCFKLVPVDPREVEEANEGENNCLLHPMSQHGMEDEDREVLKW
KFDSHLARRHMARELHPEYYKDC$

Fig. 92B

2003_CON_C nef.OPT
ATGGGCGGCAAGTGGTCCAAGTCCTCCATCGTGGGCTGGCCCGCCGTGCGCGAGCGCATCCGCCGCACCGAGCCCGCCGCCGAGGGCGTGGG
CGCCGCCTCCCAGGACCTGGACAAGCACGGCGCCCTGACCTCCTCCAACACCGCCACCAACAACGCCGACTGCGCCTGGCTGGAGGCCCAGG
AGGAGGAGGAGGAGGTGGGCTTCCCCGTGCGCCCCCAGGTGCCCCTGCGCCCCATGACCTACAAGGCCGCCTTCGACCTGTCCTTCTTCCTG
AAGGAGAAGGGCGGCCTGGAGGGCCTGATCTACTCCAAGAAGCGCCAGGAGATCCTGGACCTGTGGGTGTACCACACCCAGGGCTACTTCCC
CGACTGGCAGAACTACACCCCCGGCCCCGGCGTGCGCTACCCCCTGACCTTCGGCTGGTGCTTCAAGCTGGTGCCCGTGGACCCCCGCGAGG
TGGAGGAGGCCAACGAGGGCGAGAACAACTGCCTGCTGCACCCCATGTCCCAGCACGGCATGGAGGACGAGGACCGCGAGGTGCTGAAGTGG
AAGTTCGACTCCCACCTGGCCCGCCGCCACATGGCCCGCGAGCTGCACCCCGAGTACTACAAGGACTGCTAA

Fig. 92C

41. 2003_C.anc nef.PEP

MGGKWSKSSIVGWPAVRERMRRTEPAAEGVGAASQDLDKHGALTSSNTAANNADCAWLEAQEEEEEVGFPVRPQVPLRPMTYKAAFDLSFFL
KEKGGLDGLIYSKKRQEILDLWVYHTQGYFPDWQNYTPGPGVRYPLTFGWCFKLVPVDPREVEEANEGENNCLLHPMSQHGMEDEDREVLKW
KFDSHLARRHMARELHPEYYKDC$

Fig. 92D

2003_C.anc nef.OPT

ATGGGCGGCAAGTGGTCCAAGTCCTCCATCGTGGGCTGGCCCGCCGTGCGCGAGCGCATGCGCCGCACCGAGCCCGCCGCCGAGGGCGTGGG
CGCCGCCTCCCAGGACCTGGACAAGCACGGCGCCCTGACCTCCTCCAACACCGCCGCCAACAACGCCGACTGCGCCTGGCTGGAGGCCCAGG
AGGAGGAGGAGGAGGTGGGCTTCCCCGTGCGCCCCCAGGTGCCCCTGCGCCCCATGACCTACAAGGCCGCCTTCGACCTGTCCTTCTTCCTG
AAGGAGAAGGGCGGCCTGGACGGCCTGATCTACTCCAAGAAGCGCCAGGAGATCCTGGACCTGTGGGTGTACCACACCCAGGGCTACTTCCC
CGACTGGCAGAACTACACCCCCGGCCCCGGCGTGCGCTACCCCCTGACCTTCGGCTGGTGCTTCAAGCTGGTGCCCGTGGACCCCCGCGAGG
TGGAGGAGGCCAACGAGGGCGAGAACAACTGCCTGCTGCACCCCATGTCCCAGCACGGCATGGAGGACGAGGACCGCGAGGTGCTGAAGTGG
AAGTTCGACTCCCACCTGGCCCGCCGCCACATGGCCCGCGAGCTGCACCCCGAGTACTACAAGGACTGCTAA

Fig. 93A

42. 2003_CON_D nef.PEP

MGGKWSKSSIVGWPAIRERIRRTEPAADGVGAVSRDLEKHGAITSSNTAATNADCAWLEAQEEDEEVGFPVRPQVPLRPMTYKAALDLSHFL
KEKGGLEGLVWSQKRQEILDLWVYNTQGFFPDWQNYTPGPGIRYPLTFGWCFELVPVDPEEVEEATEGENNCLLHPMCQHGMEDPEREVLMW
RFNSRLAFEHKARVLHPEFYKDC$

Fig. 93B

2003_CON_D nef.OPT

ATGGGCGGCAAGTGGTCCAAGTCCTCCATCGTGGGCTGGCCCGCCATCCGCGAGCGCATCCGCCGCACCGAGCCCGCCGCCGACGGCGTGGG
CGCCGTGTCCCGCGACCTGGAGAAGCACGGCGCCATCACCTCCTCCAACACCGCCGCCACCAACGCCGACTGCGCCTGGCTGGAGGCCCAGG
AGGAGGACGAGGAGGTGGGCTTCCCCGTGCGCCCCCAGGTGCCCCTGCGCCCCATGACCTACAAGGCCGCCCTGGACCTGTCCCACTTCCTG
AAGGAGAAGGGCGGCCTGGAGGGCCTGGTGTGGTCCCAGAAGCGCCAGGAGATCCTGGACCTGTGGGTGTACAACACCCAGGGCTTCTTCCC
CGACTGGCAGAACTACACCCCCGGCCCCGGCATCCGCTACCCCCTGACCTTCGGCTGGTGCTTCGAGCTGGTGCCCGTGGACCCCGAGGAGG
TGGAGGAGGCCACCGAGGGCGAGAACAACTGCCTGCTGCACCCCATGTGCCAGCACGGCATGGAGGACCCCGAGCGCGAGGTGCTGATGTGG
CGCTTCAACTCCCGCCTGGCCTTCGAGCACAAGGCCCGCGTGCTGCACCCCGAGTTCTACAAGGACTGCTAA

Fig. 94A

43. 2003_CON_F1 nef.PEP

MGGKWSKSSIVGWPAVRERMRPTPPAAEGVGAVSQDLERRGAITSSNTGATNPDLAWLEAQEEEEVGFPVRPQVPLRPMTYKGAVDLSHFLK
EKGGLEGLIYSKKRQEILDLWVYHTQGYFPDWQNYTPGPGIRYPLTFGWCFKLVPVDPEEVEKANEGENNCLLHPMSQHGMEDEDREVLIWK
FDSRLALRHIARERHPEFYQD$

Fig. 94B

2003_CON_F1 nef.OPT

ATGGGCGGCAAGTGGTCCAAGTCCTCCATCGTGGGCTGGCCCGCCGTGCGCGAGCGCATGCGCCCCACCCCCCCCGCCGCCGAGGGCGTGGG
CGCCGTGTCCCAGGACCTGGAGCGCCGCGGCGCCATCACCTCCTCCAACACCGGCGCCACCAACCCCGACCTGGCCTGGCTGGAGGCCCAGG
AGGAGGAGGAGGTGGGCTTCCCCGTGCGCCCCCAGGTGCCCCTGCGCCCCATGACCTACAAGGGCGCCGTGGACCTGTCCCACTTCCTGAAG
GAGAAGGGCGGCCTGGAGGGCCTGATCTACTCCAAGAAGCGCCAGGAGATCCTGGACCTGTGGGTGTACCACACCCAGGGCTACTTCCCCGA
CTGGCAGAACTACACCCCCGGCCCCGGCATCCGCTACCCCCTGACCTTCGGCTGGTGCTTCAAGCTGGTGCCCGTGGACCCCGAGGAGGTGG
AGAAGGCCAACGAGGGCGAGAACAACTGCCTGCTGCACCCCATGTCCCAGCACGGCATGGAGGACGAGGACCGCGAGGTGCTGATCTGGAAG
TTCGACTCCCGCCTGGCCCTGCGCCACATCGCCCGCGAGCGCCACCCCGAGTTCTACCAGGACTAA

Fig. 95A

44. 2003_CON_F2 nef.PEP

MGGKWSKSSIVGWPTIRERIRRTPVAAEGVGAVSQDLDKHGAITSSNTRATNADLAWLEAQEDEEVGFPVRPQVPLRPMTYKAAFDLSHFLK
EKGGLEGLIYSKKRQEILDLWVYHTQGYFPDWQNYTPGPGTRYPLTFGWCFKLVPVDPEEVEKANEGENNCLLHPMSLHGMEDEDREVLKWK
FDSRLALRHIARERHPEYYKD$

Fig. 95B

2003_CON_F2 nef.OPT

ATGGGCGGCAAGTGGTCCAAGTCCTCCATCGTGGGCTGGCCCACCATCCGCGAGCGCATCCGCCGCACCCCCGTGGCCGCCGAGGGCGTGGG
CGCCGTGTCCCAGGACCTGGACAAGCACGGCGCCATCACCTCCTCCAACACCCGCGCCACCAACGCCGACCTGGCCTGGCTGGAGGCCCAGG
AGGACGAGGAGGTGGGCTTCCCCGTGCGCCCCCAGGTGCCCCTGCGCCCCATGACCTACAAGGCCGCCTTCGACCTGTCCCACTTCCTGAAG
GAGAAGGGCGGCCTGGAGGGCCTGATCTACTCCAAGAAGCGCCAGGAGATCCTGGACCTGTGGGTGTACCACACCCAGGGCTACTTCCCCGA
CTGGCAGAACTACACCCCCGGCCCCGGCACCCGCTACCCCCTGACCTTCGGCTGGTGCTTCAAGCTGGTGCCCGTGGACCCCGAGGAGGTGG
AGAAGGCCAACGAGGGCGAGAACAACTGCCTGCTGCACCCCATGTCCCTGCACGGCATGGAGGACGAGGACCGCGAGGTGCTGAAGTGGAAG
TTCGACTCCCGCCTGGCCCTGCGCCACATCGCCCGCGAGCGCCACCCCGAGTACTACAAGGACTAA

Fig. 96A

45. 2003_CON_G nef.PEP

MGGKWSKSSIVGWPEVRERIRQTPPAAEGVGAVSQDLARHGAITSSNTAANNPDCAWLEAQEEDSEVGFPVRPQVPLRPMTYKGAFDLSFFL
KEKGGLDGLIYSKKRQDILDLWVYNTQGFFPDWQNYTPGPGTRFPLTFGWCFKLVPMDPAEVEEANKGENNSLLHPICQHGMEDEDREVLVW
RFDSSLARRHIARELHPEYYKDC$

Fig. 96B

2003_CON_G nef.OPT

ATGGGCGGCAAGTGGTCCAAGTCCTCCATCGTGGGCTGGCCCGAGGTGCGCGAGCGCATCCGCCAGACCCCCCCCGCCGCCGAGGGCGTGGG
CGCCGTGTCCCAGGACCTGGCCCGCCACGGCGCCATCACCTCCTCCAACACCGCCGCCAACAACCCCGACTGCGCCTGGCTGGAGGCCCAGG
AGGAGGACTCCGAGGTGGGCTTCCCCGTGCGCCCCCAGGTGCCCCTGCGCCCCATGACCTACAAGGGCGCCTTCGACCTGTCCTTCTTCCTG
AAGGAGAAGGGCGGCCTGGACGGCCTGATCTACTCCAAGAAGCGCCAGGACATCCTGGACCTGTGGGTGTACAACACCCAGGGCTTCTTCCC
CGACTGGCAGAACTACACCCCCGGCCCCGGCACCCGCTTCCCCCTGACCTTCGGCTGGTGCTTCAAGCTGGTGCCCATGGACCCCGCCGAGG
TGGAGGAGGCCAACAAGGGCGAGAACAACTCCCTGCTGCACCCCATCTGCCAGCACGGCATGGAGGACGAGGACCGCGAGGTGCTGGTGTGG
CGCTTCGACTCCTCCCTGGCCCGCCGCCACATCGCCCGCGAGCTGCACCCCGAGTACTACAAGGACTGCTAA

Fig. 97A

46. 2003_CON_H nef.PEP

MGGKWSKSSIGGWPAIRERIRRAEPAAEGVGAVSRDLDRRGAVTINNTASTNPDSAWLEAQEEEEEVGFPVRPQVPLRPMTYKGAFDLSHFL
KEKGGLEGLIYSKKRQEILDLWVYNTQGYFPDWQNYTPGPGERYPLTFGWCFKLVPVDPQEVEKANEGENNSLLHPICQHGMEDEEREVLMW
KFDSRLAFRHIARELHPEFYKDC$

Fig. 97B

2003_CON_H nef.OPT

ATGGGCGGCAAGTGGTCCAAGTCCTCCATCGGCGGCTGGCCCGCCATCCGCGAGCGCATCCGCCGCGCCGAGCCCGCCGCCGAGGGCGTGGG
CGCCGTGTCCCGCGACCTGGACCGCCGCGGCGCCGTGACCATCAACAACACCGCCTCCACCAACCCCGACTCCGCCTGGCTGGAGGCCCAGG
AGGAGGAGGAGGAGGTGGGCTTCCCCGTGCGCCCCCAGGTGCCCCTGCGCCCCATGACCTACAAGGGCGCCTTCGACCTGTCCCACTTCCTG
AAGGAGAAGGGCGGCCTGGAGGGCCTGATCTACTCCAAGAAGCGCCAGGAGATCCTGGACCTGTGGGTGTACAACACCCAGGGCTACTTCCC
CGACTGGCAGAACTACACCCCCGGCCCCGGCGAGCGCTACCCCCTGACCTTCGGCTGGTGCTTCAAGCTGGTGCCCGTGGACCCCCAGGAGG
TGGAGAAGGCCAACGAGGGCGAGAACAACTCCCTGCTGCACCCCATCTGCCAGCACGGCATGGAGGACGAGGAGCGCGAGGTGCTGATGTGG
AAGTTCGACTCCCGCCTGGCCTTCCGCCACATCGCCCGCGAGCTGCACCCCGAGTTCTACAAGGACTGCTAA

Fig. 98A

47. 2003_CON_01_AE nef.PEP
MGGKWSKSSIVGWPQVRERIKQTPPATEGVGAVSQDLDKHGAVTSSNMNNADCVWLRAQEEEEVGFPVRPQVPLRPMTYKGAFDLSFFLKEK
GGLDGLIYSKKRQEILDLWVYNTQGFFPDWQNYTPGPGIRYPLCFGWCFKLVPVDPREVEEDNKGENNCLLHPMSQHGIEDEEREVLMWKFD
SALARKHIARELHPEYYKDC$

Fig. 98B

2003_CON_01_AE nef.OPT
ATGGGCGGCAAGTGGTCCAAGTCCTCCATCGTGGGCTGGCCCCAGGTGCGCGAGCGCATCAAGCAGACCCCCCCCGCCACCGAGGGCGTGGG
CGCCGTGTCCCAGGACCTGGACAAGCACGGCGCCGTGACCTCCTCCAACATGAACAACGCCGACTGCGTGTGGCTGCGCGCCCAGGAGGAGG
AGGAGGTGGGCTTCCCCGTGCGCCCCCAGGTGCCCCTGCGCCCCATGACCTACAAGGGCGCCTTCGACCTGTCCTTCTTCCTGAAGGAGAAG
GGCGGCCTGGACGGCCTGATCTACTCCAAGAAGCGCCAGGAGATCCTGGACCTGTGGGTGTACAACACCCAGGGCTTCTTCCCCGACTGGCA
GAACTACACCCCCGGCCCCGGCATCCGCTACCCCCTGTGCTTCGGCTGGTGCTTCAAGCTGGTGCCCGTGGACCCCCGCGAGGTGGAGGAGG
ACAACAAGGGCGAGAACAACTGCCTGCTGCACCCCATGTCCCAGCACGGCATCGAGGACGAGGAGCGCGAGGTGCTGATGTGGAAGTTCGAC
TCCGCCCTGGCCCGCAAGCACATCGCCCGCGAGCTGCACCCCGAGTACTACAAGGACTGCTAA

Fig. 99A

48. 2003_CON_03_AE nef.PEP
MGGKWSKSSIVGWPQVRERIRRAPAPAARGVGPVSQDLDKYGAVTSSNTAANNADCAWLEAQKEEEVGFPVRPQVPLRPMTYKGAFDLSHFL
KEKGGLDGLIYSKKRQEILDLWVYHTQGYFPDWQNYTPGPGIRFPLTFGWCYKLVPVDPDEVEEATEGENNSLLHPICQHGMDDEEKEVLMW
KFDSRLALTHRARELHPEFYKDC$

Fig. 99B

2003_CON_03_AE nef.OPT
ATGGGCGGCAAGTGGTCCAAGTCCTCCATCGTGGGCTGGCCCCAGGTGCGCGAGCGCATCCGCCGCGCCCCCGCCCCCGCCGCCCGCGGCGT
GGGCCCCGTGTCCCAGGACCTGGACAAGTACGGCGCCGTGACCTCCTCCAACACCGCCGCCAACAACGCCGACTGCGCCTGGCTGGAGGCCC
AGAAGGAGGAGGAGGTGGGCTTCCCCGTGCGCCCCCAGGTGCCCCTGCGCCCCATGACCTACAAGGGCGCCTTCGACCTGTCCCACTTCCTG
AAGGAGAAGGGCGGCCTGGACGGCCTGATCTACTCCAAGAAGCGCCAGGAGATCCTGGACCTGTGGGTGTACCACACCCAGGGCTACTTCCC
CGACTGGCAGAACTACACCCCCGGCCCCGGCATCCGCTTCCCCCTGACCTTCGGCTGGTGCTACAAGCTGGTGCCCGTGGACCCCGACGAGG
TGGAGGAGGCCACCGAGGGCGAGAACAACTCCCTGCTGCACCCCATCTGCCAGCACGGCATGGACGACGAGGAGAAGGAGGTGCTGATGTGG
AAGTTCGACTCCCGCCTGGCCCTGACCCACCGCGCCCGCGAGCTGCACCCCGAGTTCTACAAGGACTGCTAA

Fig. 100A

49. 2003_CON_04_CFX nef.PEP

MGGKWSKSSIVGWPAIRERMRQRGPAQAEPAAAGVGAVSQDLDKHGAITSSNTAATNPDKAWLEAQEEEEEVGFPVRPQVPLRPMTFKAALD
LSHFLKEKGGLDGLIYSKKRQEILDLWVYNTQGYFPDWQNYTPGPGERFPLCFGWCFKLVPVDPQEVEEATEGENNCLLHPISQHGMEDEER
EVLKWKFDSRLAYKHIARELHPEFYKDC$

Fig. 100B

2003_CON_04_CFX nef.OPT

ATGGGCGGCAAGTGGTCCAAGTCCTCCATCGTGGGCTGGCCCGCCATCCGCGAGCGCATGCGCCAGCGCGGCCCCGCCCAGGCCGAGCCCGC
CGCCGCCGGCGTGGGCGCCGTGTCCCAGGACCTGGACAAGCACGGCGCCATCACCTCCTCCAACACCGCCGCCACCAACCCCGACAAGGCCT
GGCTGGAGGCCCAGGAGGAGGAGGAGGAGGTGGGCTTCCCCGTGCGCCCCCAGGTGCCCCTGCGCCCCATGACCTTCAAGGCCGCCCTGGAC
CTGTCCCACTTCCTGAAGGAGAAGGGCGGCCTGGACGGCCTGATCTACTCCAAGAAGCGCCAGGAGATCCTGGACCTGTGGGTGTACAACAC
CCAGGGCTACTTCCCCGACTGGCAGAACTACACCCCCGGCCCCGGCGAGCGCTTCCCCCTGTGCTTCGGCTGGTGCTTCAAGCTGGTGCCCG
TGGACCCCCAGGAGGTGGAGGAGGCCACCGAGGGCGAGAACAACTGCCTGCTGCACCCCATCTCCCAGCACGGCATGGAGGACGAGGAGCGC
GAGGTGCTGAAGTGGAAGTTCGACTCCCGCCTGGCCTACAAGCACATCGCCCGCGAGCTGCACCCCGAGTTCTACAAGGACTGCTAA

Fig. 101A

50. 2003_CON_06_CFX nef.PEP

MGGKWSKSSIVGWPQVRERMRNPPTEGAAEGVGAVSQDLDKHGAITSSNTATTNAACAWLEAQTEDEVGFPVRPQVPLRPMTYKGAFDLSFF
LKEKGGLDGLIYSKKRQEILDLWVYHTQGFFPDWQNYTPGPGIRYPLTFGWCYKLVPVDPKEVEEDTKGENNCLLHPMCQHGVEDEEREVLM
WKFDSSLARRHIAREMHPEFYKDC$

Fig. 101B

2003_CON_06_CFX nef.OPT

ATGGGCGGCAAGTGGTCCAAGTCCTCCATCGTGGGCTGGCCCCAGGTGCGCGAGCGCATGCGCAACCCCCCCACCGAGGGCGCCGCCGAGGG
CGTGGGCGCCGTGTCCCAGGACCTGGACAAGCACGGCGCCATCACCTCCTCCAACACCGCCACCACCAACGCCGCCTGCGCCTGGCTGGAGG
CCCAGACCGAGGACGAGGTGGGCTTCCCCGTGCGCCCCCAGGTGCCCCTGCGCCCCATGACCTACAAGGGCGCCTTCGACCTGTCCTTCTTC
CTGAAGGAGAAGGGCGGCCTGGACGGCCTGATCTACTCCAAGAAGCGCCAGGAGATCCTGGACCTGTGGGTGTACCACACCCAGGGCTTCTT
CCCCGACTGGCAGAACTACACCCCCGGCCCCGGCATCCGCTACCCCCTGACCTTCGGCTGGTGCTACAAGCTGGTGCCCGTGGACCCCAAGG
AGGTGGAGGAGGACACCAAGGGCGAGAACAACTGCCTGCTGCACCCCATGTGCCAGCACGGCGTGGAGGACGAGGAGCGCGAGGTGCTGATG
TGGAAGTTCGACTCCTCCCTGGCCCGCCGCCACATCGCCCGCGAGATGCACCCCGAGTTCTACAAGGACTGCTAA

Fig. 102A

51. 2003_CON_08_BC nef.PEP

MGGKWSKSSIVGWPAIRERIRRTEPAADGVGAVSRDLEKHGAITSSNTADTNADCAWLETQEEEEVGFPVRPQVPLRPMTFKGALDLSFFLK
EKGGLEGLIYSKKRQEILDLWVYHTQGYFPDWHNYTPGPGVRFPLTFGWCFKLVPVDPREVEEANEGEDNCLLHPVCQHGMEDEHREVLKWK
FDSQLAHRHRARELHPEFYKDC$

Fig. 102B

2003_CON_08_BC nef.OPT

ATGGGCGGCAAGTGGTCCAAGTCCTCCATCGTGGGCTGGCCCGCCATCCGCGAGCGCATCCGCCGCACCGAGCCCGCCGCCGACGGCGTGGG
CGCCGTGTCCCGCGACCTGGAGAAGCACGGCGCCATCACCTCCTCCAACACCGCCGACACCAACGCCGACTGCGCCTGGCTGGAGACCCAGG
AGGAGGAGGAGGTGGGCTTCCCCGTGCGCCCCCAGGTGCCCCTGCGCCCCATGACCTTCAAGGGCGCCCTGGACCTGTCCTTCTTCCTGAAG
GAGAAGGGCGGCCTGGAGGGCCTGATCTACTCCAAGAAGCGCCAGGAGATCCTGGACCTGTGGGTGTACCACACCCAGGGCTACTTCCCCGA
CTGGCACAACTACACCCCCGGCCCCGGCGTGCGCTTCCCCCTGACCTTCGGCTGGTGCTTCAAGCTGGTGCCCGTGGACCCCCGCGAGGTGG
AGGAGGCCAACGAGGGCGAGGACAACTGCCTGCTGCACCCCGTGTGCCAGCACGGCATGGAGGACGAGCACCGCGAGGTGCTGAAGTGGAAG
TTCGACTCCCAGCTGGCCCACCGCCACCGCGCCCGCGAGCTGCACCCCGAGTTCTACAAGGACTGCTAA

Fig. 103A

52. 2003_CON_10_CD nef.PEP

MGGKWSKSSIVGWPAVRERIRRTDPAAEGVGAASRDLEKYGAITSSNTAQTNPDCAWLEAQEEEEEVGFPVRPQVPLRPMTYKGAFDLSFFL
KEKGGLEGLIYSKRRQDILDLWVYNTQGFFPDWQNYTPGPGIRYPLTFGWCYKLVPVDPREVEEANEGENNSLLHPMSLHGMEDPHGEVLMW
KFDSNLAHKHMARELHPEYYKDC$

Fig. 103B

2003_CON_10_CD nef.OPT

ATGGGCGGCAAGTGGTCCAAGTCCTCCATCGTGGGCTGGCCCGCCGTGCGCGAGCGCATCCGCCGCACCGACCCCGCCGCCGAGGGCGTGGG
CGCCGCCTCCCGCGACCTGGAGAAGTACGGCGCCATCACCTCCTCCAACACCGCCCAGACCAACCCCGACTGCGCCTGGCTGGAGGCCCAGG
AGGAGGAGGAGGAGGTGGGCTTCCCCGTGCGCCCCCAGGTGCCCCTGCGCCCCATGACCTACAAGGGCGCCTTCGACCTGTCCTTCTTCCTG
AAGGAGAAGGGCGGCCTGGAGGGCCTGATCTACTCCAAGCGCCGCCAGGACATCCTGGACCTGTGGGTGTACAACACCCAGGGCTTCTTCCC
CGACTGGCAGAACTACACCCCCGGCCCCGGCATCCGCTACCCCCTGACCTTCGGCTGGTGCTACAAGCTGGTGCCCGTGGACCCCCGCGAGG
TGGAGGAGGCCAACGAGGGCGAGAACAACTCCCTGCTGCACCCCATGTCCCTGCACGGCATGGAGGACCCCCACGGCGAGGTGCTGATGTGG
AAGTTCGACTCCAACCTGGCCCACAAGCACATGGCCCGCGAGCTGCACCCCGAGTACTACAAGGACTGCTAA

Fig. 104A

53. 2003_CON_11_CFX nef.PEP

MGGKWSKSSIVGWPEIRERLRRTPPTAAAEGVGAVSKDLEKHGAVTSSNTAQTNAACAWLEAQEEEEVGFPVRPQVPLRPMTYKGAFDLGFF
LKEKGGLDGLIYSKKRQEILDLWVYHTQGYFPDWQNYTPGPGIRYPLCFGWCFKLVPVEPREVEEANEGENNCLLHPMSQHGMDDEEREVLM
WKFDSSLARRHIARELHPDFYKDC$

Fig. 104B

2003_CON_11_CFX nef.OPT

ATGGGCGGCAAGTGGTCCAAGTCCTCCATCGTGGGCTGGCCCGAGATCCGCGAGCGCCTGCGCCGCACCCCCCCCACCGCCGCCGCCGAGGG
CGTGGGCGCCGTGTCCAAGGACCTGGAGAAGCACGGCGCCGTGACCTCCTCCAACACCGCCCAGACCAACGCCGCCTGCGCCTGGCTGGAGG
CCCAGGAGGAGGAGGAGGTGGGCTTCCCCGTGCGCCCCCAGGTGCCCCTGCGCCCCATGACCTACAAGGGCGCCTTCGACCTGGGCTTCTTC
CTGAAGGAGAAGGGCGGCCTGGACGGCCTGATCTACTCCAAGAAGCGCCAGGAGATCCTGGACCTGTGGGTGTACCACACCCAGGGCTACTT
CCCCGACTGGCAGAACTACACCCCCGGCCCCGGCATCCGCTACCCCCTGTGCTTCGGCTGGTGCTTCAAGCTGGTGCCCGTGGAGCCCCGCG
AGGTGGAGGAGGCCAACGAGGGCGAGAACAACTGCCTGCTGCACCCCATGTCCCAGCACGGCATGGACGACGAGGAGCGCGAGGTGCTGATG
TGGAAGTTCGACTCCTCCCTGGCCCGCCGCCACATCGCCCGCGAGCTGCACCCCGACTTCTACAAGGACTGCTAA

Fig. 105A

54. 2003_CON_12_BF nef.PEP

MGGKWSKSSIVGWPDIRERMRRAPPAAEGVGAVSQDLENRGAITSSNTRANNPDLAWLEAQEEEEVGFPVRPQVPLRPMTYKGALDLSHFLK
EKGGLEGLIYSKKRQEILDLWVYHTQGYFPDWQNYTPGPGIRYPLTFGWCFKLVPVDPEEVEKANEGENNCLLHPMSQHGMEDEDREVLMWK
FDSRLALRHIAREKHPEFYQDC$

Fig. 105B

2003_CON_12_BF nef.OPT

ATGGGCGGCAAGTGGTCCAAGTCCTCCATCGTGGGCTGGCCCGACATCCGCGAGCGCATGCGCCGCGCCCCCCCCGCCGCCGAGGGCGTGGG
CGCCGTGTCCCAGGACCTGGAGAACCGCGGCGCCATCACCTCCTCCAACACCCGCGCCAACAACCCCGACCTGGCCTGGCTGGAGGCCCAGG
AGGAGGAGGAGGTGGGCTTCCCCGTGCGCCCCCAGGTGCCCCTGCGCCCCATGACCTACAAGGGCGCCCTGGACCTGTCCCACTTCCTGAAG
GAGAAGGGCGGCCTGGAGGGCCTGATCTACTCCAAGAAGCGCCAGGAGATCCTGGACCTGTGGGTGTACCACACCCAGGGCTACTTCCCCGA
CTGGCAGAACTACACCCCCGGCCCCGGCATCCGCTACCCCCTGACCTTCGGCTGGTGCTTCAAGCTGGTGCCCGTGGACCCCGAGGAGGTGG
AGAAGGCCAACGAGGGCGAGAACAACTGCCTGCTGCACCCCATGTCCCAGCACGGCATGGAGGACGAGGACCGCGAGGTGCTGATGTGGAAG
TTCGACTCCCGCCTGGCCCTGCGCCACATCGCCCGCGAGAAGCACCCCGAGTTCTACCAGGACTGCTAA

Fig. 106A

55. 2003_CON_14_BG nef.PEP

MGGKWSKCSIVGWPEVRERIRRTPPAAVGVGAVSQDLAKHGAITSSNTAANNPDCAWLEAQEEDSEVGFPVRPQVPLRPMTYKGAFDLSFFL
KEKGGLDGLIYSKQRQDILDLWVYNTQGFFPDWQNYTPGPGTRYPLTFGWCFKLEPVDPAEVEEATKGENNSLLHPICQHGMEDADNEVLIW
RFDSSLARRHIARELHPDFYKDC$

Fig. 106B

2003_CON_14_BG nef.OPT

ATGGGCGGCAAGTGGTCCAAGTGCTCCATCGTGGGCTGGCCCGAGGTGCGCGAGCGCATCCGCCGCACCCCCCCCGCCGCCGTGGGCGTGGG
CGCCGTGTCCCAGGACCTGGCCAAGCACGGCGCCATCACCTCCTCCAACACCGCCGCCAACAACCCCGACTGCGCCTGGCTGGAGGCCCAGG
AGGAGGACTCCGAGGTGGGCTTCCCCGTGCGCCCCCAGGTGCCCCTGCGCCCCATGACCTACAAGGGCGCCTTCGACCTGTCCTTCTTCCTG
AAGGAGAAGGGCGGCCTGGACGGCCTGATCTACTCCAAGCAGCGCCAGGACATCCTGGACCTGTGGGTGTACAACACCCAGGGCTTCTTCCC
CGACTGGCAGAACTACACCCCCGGCCCCGGCACCCGCTACCCCCTGACCTTCGGCTGGTGCTTCAAGCTGGAGCCCGTGGACCCCGCCGAGG
TGGAGGAGGCCACCAAGGGCGAGAACAACTCCCTGCTGCACCCCATCTGCCAGCACGGCATGGAGGACGCCGACAACGAGGTGCTGATCTGG
CGCTTCGACTCCTCCCTGGCCCGCCGCCACATCGCCCGCGAGCTGCACCCCGACTTCTACAAGGACTGCTAA

Fig. 107A

61. 2003_2003_CON_S pol.PEP

FFRENLAFQQGEAREFSSEQTRANSPTSRELRVRGGDNPLSEAGAERQGTVSLSFPQITLWQRPLVTVKIGGQLKEALLDTGADDTVLEEIN
LPGKWKPKMIGGIGGFIKVRQYDQILIEICGKKAIGTVLVGPTPVNIIGRNMLTQIGCTLNFPISPIETVPVKLKPGMDGPKVKQWPLTEEK
IKALTEICTEMEKEGKISKIGPENPYNTPIFAIKKKDSTKWRKLVDFRELNKRTQDFWEVQLGIPHPAGLKKKKSVTVLDVGDAYFSVPLDE
DFRKYTAFTIPSINNETPGIRYQYNVLPQGWKGSPAIFQSSMTKILEPFRTQNPEIVIYQYMDDLYVGSDLEIGQHRTKIEELREHLLRWGF
TTPDKKHQKEPPFLWMGYELHPDKWTVQPIQLPEKDSWTVNDIQKLVGKLNWASQIYPGIKVKQLCKLLRGAKALTDIVPLTEEAELELAEN
REILKEPVHGVYYDPSKDLIAEIQKQGQDQWTYQIYQEPFKNLKTGKYAKMRSAHTNDVKQLTEAVQKIATESIVIWGKTPKFRLPIQKETW
ETWWTEYWQATWIPEWEFVNTPPLVKLWYQLEKEPIVGAETFYVDGAANRETKLGKAGYVTDRGRQKVVSLTETTNQKTELQAIHLALQDSG
SEVNIVTDSQYALGIIQAQPDKSESELVNQIIEQLIKKEKVYLSWVPAHKGIGGNEQVDKLVSTGIRKVLFLDGIDKAQEEHEKYHSNWRAM
ASDFNLPPIVAKEIVASCDKCQLKGEAMHGQVDCSPGIWQLDCTHLEGKIILVAVHVASGYIEAEVIPAETGQETAYFILKLAGRWPVKVIH
TDNGSNFTSAAVKAACWWAGIQQEFGIPYNPQSQGVVESMNKELKKIIGQVRDQAEHLKTAVQMAVFIHNFKRKGGIGGYSAGERIIDIIAT
DIQTKELQKQITKIQNFRVYYRDSRDPIWKGPAKLLWKGEGAVVIQDNSEIKVVPRRKAKIIRDYGKQMAGDDCVAGRQDED$

Fig. 107B

2003_CON_S pol.OPT

TTCTTCCGCGAGAACCTGGCCTTCCAGCAGGGCGAGGCCCGCGAGTTCTCCTCCGAGCAGACCCGCGCCAACTCCCCCACCTCCCGCGAGCTGCGCGTGCG
CGGCGGCGACAACCCCCTGTCCGAGGCCGGCGCCGAGCGCCAGGGCACCGTGTCCCTGTCCTTCCCCCAGATCACCCTGTGGCAGCGCCCCCTGGTGACCG
TGAAGATCGGCGGCCAGCTGAAGGAGGCCCTGCTGGACACCGGCGCCGACGACACCGTGCTGGAGGAGATCAACCTGCCCGGCAAGTGGAAGCCCAAGATG
ATCGGCGGCATCGGCGGCTTCATCAAGGTGCGCCAGTACGACCAGATCCTGATCGAGATCTGCGGCAAGAAGGCCATCGGCACCGTGCTGGTGGGCCCCAC
CCCCGTGAACATCATCGGCCGCAACATGCTGACCCAGATCGGCTGCACCCTGAACTTCCCCATCTCCCCCATCGAGACCGTGCCCGTGAAGCTGAAGCCCG
GCATGGACGGCCCCAAGGTGAAGCAGTGGCCCCTGACCGAGGAGAAGATCAAGGCCCTGACCGAGATCTGCACCGAGATGGAGAAGGAGGGCAAGATCTCC
AAGATCGGCCCCGAGAACCCCTACAACACCCCCATCTTCGCCATCAAGAAGAAGGACTCCACCAAGTGGCGCAAGCTGGTGGACTTCCGCGAGCTGAACAA
GCGCACCCAGGACTTCTGGGAGGTGCAGCTGGGCATCCCCCACCCCGCCGGCCTGAAGAAGAAGAAGTCCGTGACCGTGCTGGACGTGGGCGACGCCTACT
TCTCCGTGCCCCTGGACGAGGACTTCCGCAAGTACACCGCCTTCACCATCCCCTCCATCAACAACGAGACCCCCGGCATCCGCTACCAGTACAACGTGCTG
CCCCAGGGCTGGAAGGGCTCCCCCGCCATCTTCCAGTCCTCCATGACCAAGATCCTGGAGCCCTTCCGCACCCAGAACCCCGAGATCGTGATCTACCAGTA
CATGGACGACCTGTACGTGGGCTCCGACCTGGAGATCGGCCAGCACCGCACCAAGATCGAGGAGCTGCGCGAGCACCTGCTGCGCTGGGGCTTCACCACCC
CCGACAAGAAGCACCAGAAGGAGCCCCCCTTCCTGTGGATGGGCTACGAGCTGCACCCCGACAAGTGGACCGTGCAGCCCATCCAGCTGCCCGAGAAGGAC
TCCTGGACCGTGAACGACATCCAGAAGCTGGTGGGCAAGCTGAACTGGGCCTCCCAGATCTACCCCGGCATCAAGGTGAAGCAGCTGTGCAAGCTGCTGCG
CGGCGCCAAGGCCCTGACCGACATCGTGCCCCTGACCGAGGAGGCCGAGCTGGAGCTGGCCGAGAACCGCGAGATCCTGAAGGAGCCCGTGCACGGCGTGT
ACTACGACCCCTCCAAGGACCTGATCGCCGAGATCCAGAAGCAGGGCCAGGACCAGTGGACCTACCAGATCTACCAGGAGCCCTTCAAGAACCTGAAGACC
GGCAAGTACGCCAAGATGCGCTCCGCCCACACCAACGACGTGAAGCAGCTGACCGAGGCCGTGCAGAAGATCGCCACCGAGTCCATCGTGATCTGGGGCAA
GACCCCCAAGTTCCGCCTGCCCATCCAGAAGGAGACCTGGGAGACCTGGTGGACCGAGTACTGGCAGGCCACCTGGATCCCCGAGTGGGAGTTCGTGAACA
CCCCCCCCCTGGTGAAGCTGTGGTACCAGCTGGAGAAGGAGCCCATCGTGGGCGCCGAGACCTTCTACGTGGACGGCGCCGCCAACCGCGAGACCAAGCTG
GGCAAGGCCGGCTACGTGACCGACCGCGGCCGCCAGAAGGTGGTGTCCCTGACCGAGACCACCAACCAGAAGACCGAGCTGCAGGCCATCCACCTGGCCCT
GCAGGACTCCGGCTCCGAGGTGAACATCGTGACCGACTCCCAGTACGCCCTGGGCATCATCCAGGCCCAGCCCGACAAGTCCGAGTCCGAGCTGGTGAACC
AGATCATCGAGCAGCTGATCAAGAAGGAGAAGGTGTACCTGTCCTGGGTGCCCGCCCACAAGGGCATCGGCGGCAACGAGCAGGTGGACAAGCTGGTGTCC
ACCGGCATCCGCAAGGTGCTGTTCCTGGACGGCATCGACAAGGCCCAGGAGGAGCACGAGAAGTACCACTCCAACTGGCGCGCCATGGCCTCCGACTTCAA
CCTGCCCCCCATCGTGGCCAAGGAGATCGTGGCCTCCTGCGACAAGTGCCAGCTGAAGGGCGAGGCCATGCACGGCCAGGTGGACTGCTCCCCCGGCATCT
GGCAGCTGGACTGCACCCACCTGGAGGGCAAGATCATCCTGGTGGCCGTGCACGTGGCCTCCGGCTACATCGAGGCCGAGGTGATCCCCGCCGAGACCGGC
CAGGAGACCGCCTACTTCATCCTGAAGCTGGCCGGCCGCTGGCCCGTGAAGGTGATCCACACCGACAACGGCTCCAACTTCACCTCCGCCGCCGTGAAGGC
CGCCTGCTGGTGGGCCGGCATCCAGCAGGAGTTCGGCATCCCCTACAACCCCCAGTCCCAGGGCGTGGTGGAGTCCATGAACAAGGAGCTGAAGAAGATCA
TCGGCCAGGTGCGCGACCAGGCCGAGCACCTGAAGACCGCCGTGCAGATGGCCGTGTTCATCCACAACTTCAAGCGCAAGGGCGGCATCGGCGGCTACTCC
GCCGGCGAGCGCATCATCGACATCATCGCCACCGACATCCAGACCAAGGAGCTGCAGAAGCAGATCACCAAGATCCAGAACTTCCGCGTGTACTACCGCGA
CTCCCGCGACCCCATCTGGAAGGGCCCCGCCAAGCTGCTGTGGAAGGGCGAGGGCGCCGTGGTGATCCAGGACAACTCCGAGATCAAGGTGGTGCCCCGCC
GCAAGGCCAAGATCATCCGCGACTACGGCAAGCAGATGGCCGGCGACGACTGCGTGGCCGGCCGCCAGGACGAGGACTAA

Fig. 108A

62 2003_M GROUP anc pol.PEP

FFRENLAFQQGEAREFSSEQTRANSPTSRELRVRGGDNPLSEAGAERQGTVSFSFPQITLWQRPLVTIKIGGQLREALLDTGADDTVLEEIN
LPGKWKPKMIGGIGGFIKVRQYDQILIEICGKKAIGTVLVGPTPVNIIGRNMLTQIGCTLNFPISPIETVPVKLKPGMDGPKVKQWPLTEEK
IKALTEICTEMEKEGKISKIGPENPYNTPVFAIKKKDSTKWRKLVDFRELNKRTQDFWEVQLGIPHPAGLKKKKSVTVLDVGDAYFSVPLDE
DFRKYTAFTIPSINNETPGIRYQYNVLPQGWKGSPAIFQSSMTKILEPFRTKNPEIVIYQYMDDLYVGSDLEIGQHRAKIEELREHLLRWGF
TTPDKKHQKEPPFLWMGYELHPDKWTVQPIQLPEKDSWTVNDIQKLVGKLNWASQIYPGIKVKQLCKLLRGAKALTDIVPLTEEAELELAEN
REILKEPVHGVYYDPSKDLIAEIQKQGQDQWTYQIYQEPFKNLKTGKYAKMRSAHTNDVKQLTEAVQKIATESIVIWGKTPKFRLPIQKETW
ETWWTEYWQATWIPEWEFVNTPPLVKLWYQLEKEPIVGAETFYVDGAANRETKLGKAGYVTDRGRQKVVSLTETTNQKTELQAIHLALQDSG
SEVNIVTDSQYALGIIQAQPDKSESELVNQIIEQLIKKEKVYLSWVPAHKGIGGNEQVDKLVSSGIRKVLFLDGIDKAQEEHEKYHSNWRAM
ASDFNLPPVVAKEIVASCDKCQLKGEAMHGQVDCSPGIWQLDCTHLEGKVILVAVHVASGYIEAEVIPAETGQETAYFILKLAGRWPVKVIH
TDNGSNFTSAAVKAACWWAGIQQEFGIPYNPQSQGVVESMNKELKKIIGQVRDQAEHLKTAVQMAVFIHNFKRKGGIGGYSAGERIIDIIAT
DIQTKELQKQITKIQNFRVYYRDSRDPIWKGPAKLLWKGEGAVVIQDNSEIKVVPRRKAKIIRDYGKQMAGDDCVAGRQDED$

Fig. 109A

63. 2003_CON_A1 pol.PEP

FFRENLAFQQGEARKFSSEQTGANSPTSRDLWDGGRDSLPSEAGAERQGTGPTFSFPQITLWQRPLVTVRIGGQLKEALLDTGADDTVLEDI
NLPGKWKPKMIGGIGGFIKVKQYDQILIEICGKKAIGTVLVGPTPVNIIGRNMLTQIGCTLNFPISPIETVPVKLKPGMDGPKVKQWPLTEE
KIKALTEICTEMEKEGKISKIGPENPYNTPIFAIKKKDSTKWRKLVDFRELNKRTQDFWEVQLGIPHPAGLKKKKSVTVLDVGDAYFSVPLD
ESFRKYTAFTIPSTNNETPGIRYQYNVLPQGWKGSPAIFQSSMTKILEPFRSKNPEIIIYQYMDDLYVGSDLEIGQHRTKIEELRAHLLSWG
FTTPDKKHQKEPPFLWMGYELHPDKWTVQPIELPEKESWTVNDIQKLVGKLNWASQIYAGIKVKQLCKLLRGAKALTDIVTLTEEAELELAE
NREILKDPVHGVYYDPSKDLIAEIQKQGQDQWTYQIYQEPFKNLKTGKYARKRSAHTNDVKQLAEVVQKVVMESIVIWGKTPKFKLPIQKET
WETWWMDYWQATWIPEWEFVNTPPLVKLWYQLEKDPIVGAETFYVDGAANRETKLGKAGYVTDRGRQKVVSLTETTNQKTELHAIHLALQDS
GSEVNIVTDSQYALGIIQAQPDRSESELVNQIIEKLIGKDKVYLSWVPAHKGIGGNEQVDKLVSSGIRKVLFLDGIDKAQEEHERYHSNWRA
MASDFNLPPIVAKEIVASCDKCQLKGEAMHGQVDCSPGIWQLDCTHLEGKVILVAVHVASGYIEAEVIPAETGQETAYFLLKLAGRWPVKVV
HTDNGSNFTSAAVKAACWWANIQQEFGIPYNPQSQGVVESMNKELKKIIGQVREQAEHLKTAVQMAVFIHNFKRKGGIGGYSAGERIIDIIA
TDIQTKELQKQITKIQNFRVYYRDSRDPIWKGPAKLLWKGEGAVVIQDNSDIKVVPRRKAKIIRDYGKQMAGDDCVAGRQDED$

Fig. 108B

2003_M.GROUP anc pol.OPT

TTCTTCCGCGAGAACCTGGCCTTCCAGCAGGGCGAGGCCCGCGAGTTCTCCTCCGAGCAGACCCGCGCCAACTCCCCCACCTCCCGCGAGCTGCGCGTGCG
CGGCGGCGACAACCCCCTGTCCGAGGCCGGCGCCGAGCGCCAGGGCACCGTGTCCTTCTCCTTCCCCCAGATCACCCTGTGGCAGCGCCCCCTGGTGACCA
TCAAGATCGGCGGCCAGCTGCGCGAGGCCCTGCTGGACACCGGCGCCGACGACACCGTGCTGGAGGAGATCAACCTGCCCGGCAAGTGGAAGCCCAAGATG
ATCGGCGGCATCGGCGGCTTCATCAAGGTGCGCCAGTACGACCAGATCCTGATCGAGATCTGCGGCAAGAAGGCCATCGGCACCGTGCTGGTGGGCCCCAC
CCCCGTGAACATCATCGGCCGCAACATGCTGACCCAGATCGGCTGCACCCTGAACTTCCCCATCTCCCCCATCGAGACCGTGCCCGTGAAGCTGAAGCCCG
GCATGGACGGCCCCAAGGTGAAGCAGTGGCCCCTGACCGAGGAGAAGATCAAGGCCCTGACCGAGATCTGCACCGAGATGGAGAAGGAGGGCAAGATCTCC
AAGATCGGCCCCGAGAACCCCTACAACACCCCCGTGTTCGCCATCAAGAAGAAGGACTCCACCAAGTGGCGCAAGCTGGTGGACTTCCGCGAGCTGAACAA
GCGCACCCAGGACTTCTGGGAGGTGCAGCTGGGCATCCCCCACCCCGCCGGCCTGAAGAAGAAGAAGTCCGTGACCGTGCTGGACGTGGGCGACGCCTACT
TCTCCGTGCCCCTGGACGAGGACTTCCGCAAGTACACCGCCTTCACCATCCCCTCCATCAACAACGAGACCCCCGGCATCCGCTACCAGTACAACGTGCTG
CCCCAGGGCTGGAAGGGCTCCCCCGCCATCTTCCAGTCCTCCATGACCAAGATCCTGGAGCCCTTCCGCACCAAGAACCCCGAGATCGTGATCTACCAGTA
CATGGACGACCTGTACGTGGGCTCCGACCTGGAGATCGGCCAGCACCGCGCCAAGATCGAGGAGCTGCGCGAGCACCTGCTGCGCTGGGGCTTCACCACCC
CCGACAAGAAGCACCAGAAGGAGCCCCCCTTCCTGTGGATGGGCTACGAGCTGCACCCCGACAAGTGGACCGTGCAGCCCATCCAGCTGCCCGAGAAGGAC
TCCTGGACCGTGAACGACATCCAGAAGCTGGTGGGCAAGCTGAACTGGGCCTCCCAGATCTACCCCGGCATCAAGGTGAAGCAGCTGTGCAAGCTGCTGCG
CGGCGCCAAGGCCCTGACCGACATCGTGCCCCTGACCGAGGAGGCCGAGCTGGAGCTGGCCGAGAACCGCGAGATCCTGAAGGAGCCCGTGCACGGCGTGT
ACTACGACCCCTCCAAGGACCTGATCGCCGAGATCCAGAAGCAGGGCCAGGACCAGTGGACCTACCAGATCTACCAGGAGCCCTTCAAGAACCTGAAGACC
GGCAAGTACGCCAAGATGCGCTCCGCCCACACCAACGACGTGAAGCAGCTGACCGAGGCCGTGCAGAAGATCGCCACCGAGTCCATCGTGATCTGGGGCAA
GACCCCCAAGTTCCGCCTGCCCATCCAGAAGGAGACCTGGGAGACCTGGTGGACCGAGTACTGGCAGGCCACCTGGATCCCCGAGTGGGAGTTCGTGAACA
CCCCCCCCCTGGTGAAGCTGTGGTACCAGCTGGAGAAGGAGCCCATCGTGGGCGCCGAGACCTTCTACGTGGACGGCGCCGCCAACCGCGAGACCAAGCTG
GGCAAGGCCGGCTACGTGACCGACCGCGGCCGCCAGAAGGTGGTGTCCCTGACCGAGACCACCAACCAGAAGACCGAGCTGCAGGCCATCCACCTGGCCCT
GCAGGACTCCGGCTCCGAGGTGAACATCGTGACCGACTCCCAGTACGCCCTGGGCATCATCCAGGCCCAGCCCGACAAGTCCGAGTCCGAGCTGGTGAACC
AGATCATCGAGCAGCTGATCAAGAAGGAGAAGGTGTACCTGTCCTGGGTGCCCGCCCACAAGGGCATCGGCGGCAACGAGCAGGTGGACAAGCTGGTGTCC
TCCGGCATCCGCAAGGTGCTGTTCCTGGACGGCATCGACAAGGCCCAGGAGGAGCACGAGAAGTACCACTCCAACTGGCGCGCCATGGCCTCCGACTTCAA
CCTGCCCCCCGTGGTGGCCAAGGAGATCGTGGCCTCCTGCGACAAGTGCCAGCTGAAGGGCGAGGCCATGCACGGCCAGGTGGACTGCTCCCCCGGCATCT
GGCAGCTGGACTGCACCCACCTGGAGGGCAAGGTGATCCTGGTGGCCGTGCACGTGGCCTCCGGCTACATCGAGGCCGAGGTGATCCCCGCCGAGACCGGC
CAGGAGACCGCCTACTTCATCCTGAAGCTGGCCGGCCGCTGGCCCGTGAAGGTGATCCACACCGACAACGGCTCCAACTTCACCTCCGCCGCCGTGAAGGC
CGCCTGCTGGTGGGCCGGCATCCAGCAGGAGTTCGGCATCCCCTACAACCCCCAGTCCCAGGGCGTGGTGGAGTCCATGAACAAGGAGCTGAAGAAGATCA
TCGGCCAGGTGCGCGACCAGGCCGAGCACCTGAAGACCGCCGTGCAGATGGCCGTGTTCATCCACAACTTCAAGCGCAAGGGCGGCATCGGCGGCTACTCC
GCCGGCGAGCGCATCATCGACATCATCGCCACCGACATCCAGACCAAGGAGCTGCAGAAGCAGATCACCAAGATCCAGAACTTCCGCGTGTACTACCGCGA
CTCCCGCGACCCCATCTGGAAGGGCCCCGCCAAGCTGCTGTGGAAGGGCGAGGGCGCCGTGGTGATCCAGGACAACTCCGAGATCAAGGTGGTGCCCCGCC
GCAAGGCCAAGATCATCCGCGACTACGGCAAGCAGATGGCCGGCGACGACTGCGTGGCCGGCCGCCAGGACGAGGACTAA

Fig. 109B

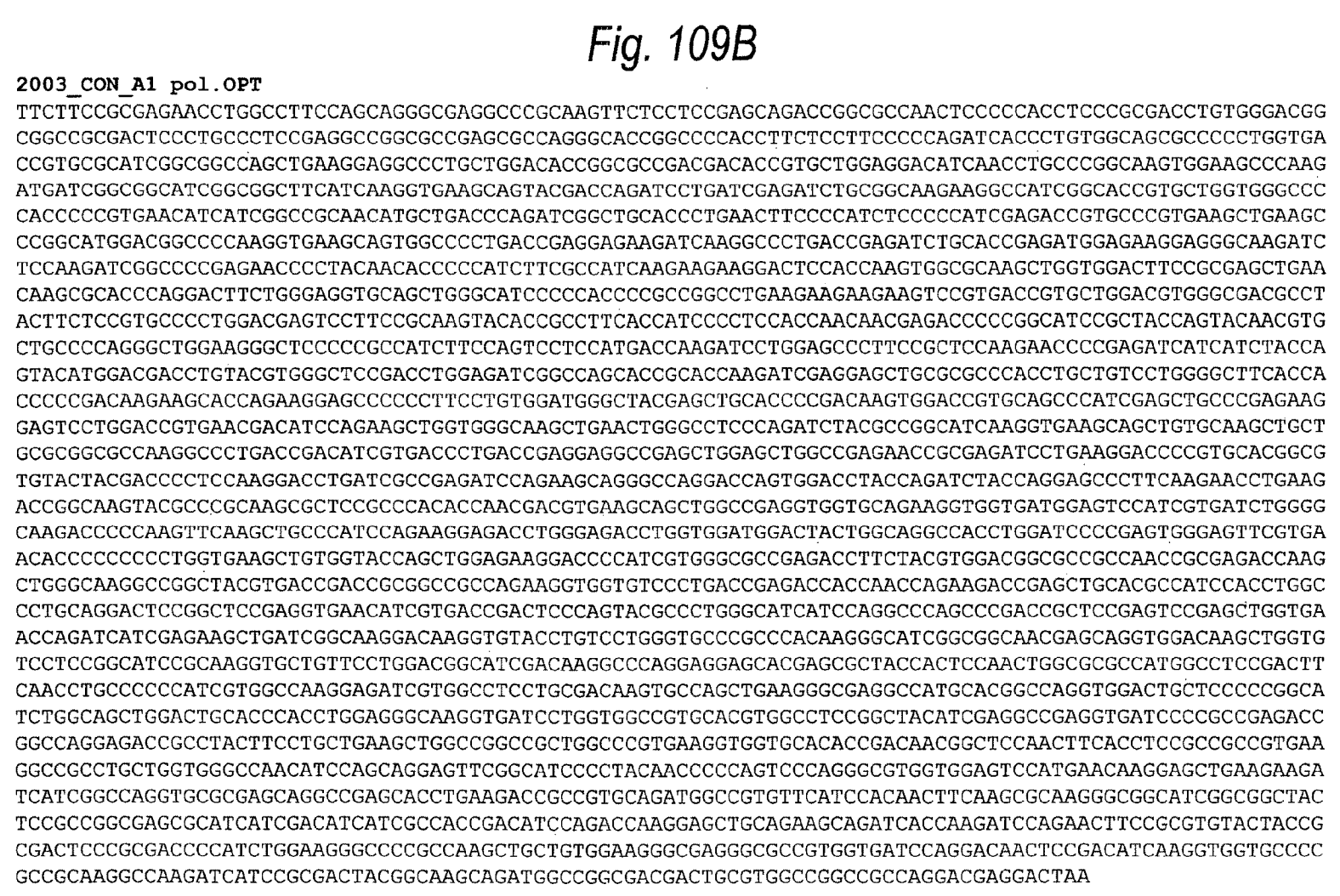

2003_CON_A1 pol.OPT

TTCTTCCGCGAGAACCTGGCCTTCCAGCAGGGCGAGGCCCGCAAGTTCTCCTCCGAGCAGACCGGCGCCAACTCCCCCACCTCCCGCGACCTGTGGGACGG
CGGCCGCGACTCCCTGCCCTCCGAGGCCGGCGCCGAGCGCCAGGGCACCGGCCCCACCTTCTCCTTCCCCCAGATCACCCTGTGGCAGCGCCCCCTGGTGA
CCGTGCGCATCGGCGGCCAGCTGAAGGAGGCCCTGCTGGACACCGGCGCCGACGACACCGTGCTGGAGGACATCAACCTGCCCGGCAAGTGGAAGCCCAAG
ATGATCGGCGGCATCGGCGGCTTCATCAAGGTGAAGCAGTACGACCAGATCCTGATCGAGATCTGCGGCAAGAAGGCCATCGGCACCGTGCTGGTGGGCCC
CACCCCCGTGAACATCATCGGCCGCAACATGCTGACCCAGATCGGCTGCACCCTGAACTTCCCCATCTCCCCCATCGAGACCGTGCCCGTGAAGCTGAAGC
CCGGCATGGACGGCCCCAAGGTGAAGCAGTGGCCCCTGACCGAGGAGAAGATCAAGGCCCTGACCGAGATCTGCACCGAGATGGAGAAGGAGGGCAAGATC
TCCAAGATCGGCCCCGAGAACCCCTACAACACCCCCATCTTCGCCATCAAGAAGAAGGACTCCACCAAGTGGCGCAAGCTGGTGGACTTCCGCGAGCTGAA
CAAGCGCACCCAGGACTTCTGGGAGGTGCAGCTGGGCATCCCCCACCCCGCCGGCCTGAAGAAGAAGAAGTCCGTGACCGTGCTGGACGTGGGCGACGCCT
ACTTCTCCGTGCCCCTGGACGAGTCCTTCCGCAAGTACACCGCCTTCACCATCCCCTCCACCAACAACGAGACCCCCGGCATCCGCTACCAGTACAACGTG
CTGCCCCAGGGCTGGAAGGGCTCCCCCGCCATCTTCCAGTCCTCCATGACCAAGATCCTGGAGCCCTTCCGCTCCAAGAACCCCGAGATCATCATCTACCA
GTACATGGACGACCTGTACGTGGGCTCCGACCTGGAGATCGGCCAGCACCGCACCAAGATCGAGGAGCTGCGCGCCCACCTGCTGTCCTGGGGCTTCACCA
CCCCCGACAAGAAGCACCAGAAGGAGCCCCCCTTCCTGTGGATGGGCTACGAGCTGCACCCCGACAAGTGGACCGTGCAGCCCATCGAGCTGCCCGAGAAG
GAGTCCTGGACCGTGAACGACATCCAGAAGCTGGTGGGCAAGCTGAACTGGGCCTCCCAGATCTACGCCGGCATCAAGGTGAAGCAGCTGTGCAAGCTGCT
GCGCGGCGCCAAGGCCCTGACCGACATCGTGACCCTGACCGAGGAGGCCGAGCTGGAGCTGGCCGAGAACCGCGAGATCCTGAAGGACCCCGTGCACGGCG
TGTACTACGACCCCTCCAAGGACCTGATCGCCGAGATCCAGAAGCAGGGCCAGGACCAGTGGACCTACCAGATCTACCAGGAGCCCTTCAAGAACCTGAAG
ACCGGCAAGTACGCCCGCAAGCGCTCCGCCCACACCAACGACGTGAAGCAGCTGGCCGAGGTGGTGCAGAAGGTGGTGATGGAGTCCATCGTGATCTGGGG
CAAGACCCCCAAGTTCAAGCTGCCCATCCAGAAGGAGACCTGGGAGACCTGGTGGATGGACTACTGGCAGGCCACCTGGATCCCCGAGTGGGAGTTCGTGA
ACACCCCCCCCCTGGTGAAGCTGTGGTACCAGCTGGAGAAGGACCCCATCGTGGGCGCCGAGACCTTCTACGTGGACGGCGCCGCCAACCGCGAGACCAAG
CTGGGCAAGGCCGGCTACGTGACCGACCGCGGCCGCCAGAAGGTGGTGTCCCTGACCGAGACCACCAACCAGAAGACCGAGCTGCACGCCATCCACCTGGC
CCTGCAGGACTCCGGCTCCGAGGTGAACATCGTGACCGACTCCCAGTACGCCCTGGGCATCATCCAGGCCCAGCCCGACCGCTCCGAGTCCGAGCTGGTGA
ACCAGATCATCGAGAAGCTGATCGGCAAGGACAAGGTGTACCTGTCCTGGGTGCCCGCCCACAAGGGCATCGGCGGCAACGAGCAGGTGGACAAGCTGGTG
TCCTCCGGCATCCGCAAGGTGCTGTTCCTGGACGGCATCGACAAGGCCCAGGAGGAGCACGAGCGCTACCACTCCAACTGGCGCGCCATGGCCTCCGACTT
CAACCTGCCCCCCATCGTGGCCAAGGAGATCGTGGCCTCCTGCGACAAGTGCCAGCTGAAGGGCGAGGCCATGCACGGCCAGGTGGACTGCTCCCCCGGCA
TCTGGCAGCTGGACTGCACCCACCTGGAGGGCAAGGTGATCCTGGTGGCCGTGCACGTGGCCTCCGGCTACATCGAGGCCGAGGTGATCCCCGCCGAGACC
GGCCAGGAGACCGCCTACTTCCTGCTGAAGCTGGCCGGCCGCTGGCCCGTGAAGGTGGTGCACACCGACAACGGCTCCAACTTCACCTCCGCCGCCGTGAA
GGCCGCCTGCTGGTGGGCCAACATCCAGCAGGAGTTCGGCATCCCCTACAACCCCCAGTCCCAGGGCGTGGTGGAGTCCATGAACAAGGAGCTGAAGAAGA
TCATCGGCCAGGTGCGCGAGCAGGCCGAGCACCTGAAGACCGCCGTGCAGATGGCCGTGTTCATCCACAACTTCAAGCGCAAGGGCGGCATCGGCGGCTAC
TCCGCCGGCGAGCGCATCATCGACATCATCGCCACCGACATCCAGACCAAGGAGCTGCAGAAGCAGATCACCAAGATCCAGAACTTCCGCGTGTACTACCG
CGACTCCCGCGACCCCATCTGGAAGGGCCCCGCCAAGCTGCTGTGGAAGGGCGAGGGCGCCGTGGTGATCCAGGACAACTCCGACATCAAGGTGGTGCCCC
GCCGCAAGGCCAAGATCATCCGCGACTACGGCAAGCAGATGGCCGGCGACGACTGCGTGGCCGGCCGCCAGGACGAGGACTAA

Fig. 109C

64. 2003_A1.anc pol.PEP

FFRENLAFQQGEARKFSSEQTRANSPTSRELWDGGRDSLLSEAGAERQGTVPSFSFPQITLWQRPLVTVKIGGQLKEALLDTGADDTVLEDI
NLPGKWKPKMIGGIGGFIKVRQYDQILIEICGKKAIGTVLVGPTPVNIIGRNMLTQIGCTLNFPISPIETVPVKLKPGMDGPKVKQWPLTEE
KIKALTEICTEMEKEGKISKIGPENPYNTPVFAIKKKDSTKWRKLVDFRELNKRTQDFWEVQLGIPHPAGLKKKKSVTVLDVGDAYFSVPLD
ESFRKYTAFTIPSINNETPGIRYQYNVLPQGWKGSPAIFQSSMTKILEPFRSKNPEIVIYQYMDDLYVGSDLEIGQHRAKIEELRAHLLSWG
FTTPDKKHQKEPPFLWMGYELHPDKWTVQPIKLPEKDSWTVNDIQKLVGKLNWASQIYAGIKVKQLCKLLRGAKALTDIVTLTEEAELELAE
NREILKDPVHGVYYDPSKDLVAEIQKQGQDQWTYQIYQEPFKNLKTGKYAKKRSAHTNDVKQLTEVVQKVATESIVIWGKTPKFRLPIQKET
WETWWMEYWQATWIPEWEFVNTPPLVKLWYQLEKEPIAGAETFYVDGAANRETKLGKAGYVTDRGRQKVVSLTETTNQKTELHAIHLALQDS
GSEVNIVTDSQYALGIIQAQPDRSESELVNQIIEKLIEKEKVYLSWVPAHKGIGGNEQVDKLVSSGIRKVLFLDGIDKAQEEHEKYHSNWRA
MASDFNLPPIVAKEIVASCDKCQLKGEAMHGQVDCSPGIWQLDCTHLEGKVILVAVHVASGYIEAEVIPAETGQETAYFLLKLAGRWPVKVV
HTDNGSNFTSAAVKAACWWANIQQEFGIPYNPQSQGVVESMNKELKKIIGQVREQAEHLKTAVQMAVFIHNFKRKGGIGGYSAGERIIDIIA
TDIQTKELQKQITKIQNFRVYYRDSRDPIWKGPAKLLWKGEGAVVIQDNSDIKVVPRRKAKIIRDYGKQMAGDDCVAGRQDED$

Fig. 109D

2003_A1.anc pol.OPT

TTCTTCCGCGAGAACCTGGCCTTCCAGCAGGGCGAGGCCCGCAAGTTCTCCTCCGAGCAGACCCGCGCCAACTCCCCCACCTCCCGCGAGCTGTGGGACGG
CGGCCGCGACTCCCTGCTGTCCGAGGCCGGCGCCGAGCGCCAGGGCACCGTGCCCTCCTTCTCCTTCCCCCAGATCACCCTGTGGCAGCGCCCCCTGGTGA
CCGTGAAGATCGGCGGCCAGCTGAAGGAGGCCCTGCTGGACACCGGCGCCGACGACACCGTGCTGGAGGACATCAACCTGCCCGGCAAGTGGAAGCCCAAG
ATGATCGGCGGCATCGGCGGCTTCATCAAGGTGCGCCAGTACGACCAGATCCTGATCGAGATCTGCGGCAAGAAGGCCATCGGCACCGTGCTGGTGGGCCC
CACCCCCGTGAACATCATCGGCCGCAACATGCTGACCCAGATCGGCTGCACCCTGAACTTCCCCATCTCCCCCATCGAGACCGTGCCCGTGAAGCTGAAGC
CCGGCATGGACGGCCCCAAGGTGAAGCAGTGGCCCCTGACCGAGGAGAAGATCAAGGCCCTGACCGAGATCTGCACCGAGATGGAGAAGGAGGGCAAGATC
TCCAAGATCGGCCCCGAGAACCCCTACAACACCCCCGTGTTCGCCATCAAGAAGAAGGACTCCACCAAGTGGCGCAAGCTGGTGGACTTCCGCGAGCTGAA
CAAGCGCACCCAGGACTTCTGGGAGGTGCAGCTGGGCATCCCCCACCCCGCCGGCCTGAAGAAGAAGAAGTCCGTGACCGTGCTGGACGTGGGCGACGCCT
ACTTCTCCGTGCCCCTGGACGAGTCCTTCCGCAAGTACACCGCCTTCACCATCCCCTCCATCAACAACGAGACCCCCGGCATCCGCTACCAGTACAACGTG
CTGCCCCAGGGCTGGAAGGGCTCCCCCGCCATCTTCCAGTCCTCCATGACCAAGATCCTGGAGCCCTTCCGCTCCAAGAACCCCGAGATCGTGATCTACCA
GTACATGGACGACCTGTACGTGGGCTCCGACCTGGAGATCGGCCAGCACCGCGCCAAGATCGAGGAGCTGCGCGCCCACCTGCTGTCCTGGGGCTTCACCA
CCCCCGACAAGAAGCACCAGAAGGAGCCCCCCTTCCTGTGGATGGGCTACGAGCTGCACCCCGACAAGTGGACCGTGCAGCCCATCAAGCTGCCCGAGAAG
GACTCCTGGACCGTGAACGACATCCAGAAGCTGGTGGGCAAGCTGAACTGGGCCTCCCAGATCTACGCCGGCATCAAGGTGAAGCAGCTGTGCAAGCTGCT
GCGCGGCGCCAAGGCCCTGACCGACATCGTGACCCTGACCGAGGAGGCCGAGCTGGAGCTGGCCGAGAACCGCGAGATCCTGAAGGACCCCGTGCACGGCG
TGTACTACGACCCCTCCAAGGACCTGGTGGCCGAGATCCAGAAGCAGGGCCAGGACCAGTGGACCTACCAGATCTACCAGGAGCCCTTCAAGAACCTGAAG
ACCGGCAAGTACGCCAAGAAGCGCTCCGCCCACACCAACGACGTGAAGCAGCTGACCGAGGTGGTGCAGAAGGTGGCCACCGAGTCCATCGTGATCTGGGG
CAAGACCCCCAAGTTCCGCCTGCCCATCCAGAAGGAGACCTGGGAGACCTGGTGGATGGAGTACTGGCAGGCCACCTGGATCCCCGAGTGGGAGTTCGTGA
ACACCCCCCCCCTGGTGAAGCTGTGGTACCAGCTGGAGAAGGAGCCCATCGCCGGCGCCGAGACCTTCTACGTGGACGGCGCCGCCAACCGCGAGACCAAG
CTGGGCAAGGCCGGCTACGTGACCGACCGCGGCCGCCAGAAGGTGGTGTCCCTGACCGAGACCACCAACCAGAAGACCGAGCTGCACGCCATCCACCTGGC
CCTGCAGGACTCCGGCTCCGAGGTGAACATCGTGACCGACTCCCAGTACGCCCTGGGCATCATCCAGGCCCAGCCCGACCGCTCCGAGTCCGAGCTGGTGA
ACCAGATCATCGAGAAGCTGATCGAGAAGGAGAAGGTGTACCTGTCCTGGGTGCCCGCCCACAAGGGCATCGGCGGCAACGAGCAGGTGGACAAGCTGGTG
TCCTCCGGCATCCGCAAGGTGCTGTTCCTGGACGGCATCGACAAGGCCCAGGAGGAGCACGAGAAGTACCACTCCAACTGGCGCGCCATGGCCTCCGACTT
CAACCTGCCCCCCATCGTGGCCAAGGAGATCGTGGCCTCCTGCGACAAGTGCCAGCTGAAGGGCGAGGCCATGCACGGCCAGGTGGACTGCTCCCCCGGCA
TCTGGCAGCTGGACTGCACCCACCTGGAGGGCAAGGTGATCCTGGTGGCCGTGCACGTGGCCTCCGGCTACATCGAGGCCGAGGTGATCCCCGCCGAGACC
GGCCAGGAGACCGCCTACTTCCTGCTGAAGCTGGCCGGCCGCTGGCCCGTGAAGGTGGTGCACACCGACAACGGCTCCAACTTCACCTCCGCCGCCGTGAA
GGCCGCCTGCTGGTGGGCCAACATCCAGCAGGAGTTCGGCATCCCCTACAACCCCCAGTCCCAGGGCGTGGTGGAGTCCATGAACAAGGAGCTGAAGAAGA
TCATCGGCCAGGTGCGCGAGCAGGCCGAGCACCTGAAGACCGCCGTGCAGATGGCCGTGTTCATCCACAACTTCAAGCGCAAGGGCGGCATCGGCGGCTAC
TCCGCCGGCGAGCGCATCATCGACATCATCGCCACCGACATCCAGACCAAGGAGCTGCAGAAGCAGATCACCAAGATCCAGAACTTCCGCGTGTACTACCG
CGACTCCCGCGACCCCATCTGGAAGGGCCCCGCCAAGCTGCTGTGGAAGGGCGAGGGCGCCGTGGTGATCCAGGACAACTCCGACATCAAGGTGGTGCCCC
GCCGCAAGGCCAAGATCATCCGCGACTACGGCAAGCAGATGGCCGGCGACGACTGCGTGGCCGGCCGCCAGGACGAGGACTAA

*Fig. 110A*

65. 2003_CON_A2 pol.PEP

FFRENLAFQQREARKFSSEQNRANSPTSRELRNGGRDNLLSEAGAEEQGTVHSCNFPQITLWQRPLVTVKIEGQLREALLDTGADDTVLEDI
NLPGKWKPKMIGGIGGFIKVRQYDQIAIEICGKRAIGTVLVGPTPVNIIGRNMLVQLGCTLNFPISPIETVPVKLKPGMDGPKVKQWPLTEE
KIKALTEICKEMEKEGKISKIGPENPYNTPVFAIKKKDSTKWRKLVDFRELNKRTQDFWEVQLGIPHPAGLKKKKSVTVLDVGDAYFSVPLH
EDFRKYTAFTIPSINNETPGIRYQYNVLPQGWKGSPAIFQSSMTKILEPFRSKNPEMVIYQYMDDLYVGSDLEIGQHRAKIEELRAHLLRWG
FTTPDKKHQKEPPFLWMGYELHPDKWTVQPIKLPEKDSWTVNDIQKLVGKLNWASQIYAGIKVKQLCKLLRGTKALTDIVTLTKEAELELEE
NREILKNPVHGVYYDPSKDLIAEIQKQGQDQWTYQIYQEPFKNLKTGKYAKRKSTHTNDVKQLTEAVQKIAIESIVIWGKTPKFRLPIQKET
WETWWTEYWQATWIPEWEFVNTPPLVKLWYQLETEPIAGAETFYVDGAANRETKLGKAGYVTDRGRQKIVSLTETTNQKTELHAIYLALQDS
GLEVNIVTDSQYALGIIQAQPDRSESELVNQIIEKLIEKERVYLSWVPAHKGIGGNEQVDKLVSSGIRKVLFLDGIDKAQEEHERYHSNWRA
MAHDFNLPPIVAKEIVASCDKCQLKGEAMHGQVDCSPGIWQLDCTHLEGKVILVAVHVASGYIEAEVIPAETGQETAYFILKLAGRWPVKVI
HTDNGPNFTSATVKAACWWAGVQQEFGIPYNPQSQGVVESMNKELKKIIGQVRDQAEHLKTAVQMAVFIHNFKRKGGIGGYSAGERIIDIIA
TDIQTKELQKQIIKIQNFRVYYRDSRDPIWKGPAKLLWKGEGAVVIQDNSDIKVVPRRKAKIIRDYGKQMAGDDCVAGRQDED$

*Fig. 111A*

66. 2003_CON_B pol.PEP

FFREDLAFPQGKAREFSSEQTRANSPTRRELQVWGRDNNSLSEAGADRQGTVSFSFPQITLWQRPLVTIKIGGQLKEALLDTGADDTVLEEM
NLPGRWKPKMIGGIGGFIKVRQYDQILIEICGHKAIGTVLVGPTPVNIIGRNLLTQIGCTLNFPISPIETVPVKLKPGMDGPKVKQWPLTEE
KIKALVEICTEMEKEGKISKIGPENPYNTPVFAIKKKDSTKWRKLVDFRELNKRTQDFWEVQLGIPHPAGLKKKKSVTVLDVGDAYFSVPLD
KDFRKYTAFTIPSINNETPGIRYQYNVLPQGWKGSPAIFQSSMTKILEPFRKQNPDIVIYQYMDDLYVGSDLEIGQHRTKIEELRQHLLRWG
FTTPDKKHQKEPPFLWMGYELHPDKWTVQPIVLPEKDSWTVNDIQKLVGKLNWASQIYAGIKVKQLCKLLRGTKALTEVIPLTEEAELELAE
NREILKEPVHGVYYDPSKDLIAEIQKQGQGQWTYQIYQEPFKNLKTGKYARMRGAHTNDVKQLTEAVQKIATESIVIWGKTPKFKLPIQKET
WEAWWTEYWQATWIPEWEFVNTPPLVKLWYQLEKEPIVGAETFYVDGAANRETKLGKAGYVTDRGRQKVVSLTDTTNQKTELQAIHLALQDS
GLEVNIVTDSQYALGIIQAQPDKSESELVSQIIEQLIKKEKVYLAWVPAHKGIGGNEQVDKLVSAGIRKVLFLDGIDKAQEEHEKYHSNWRA
MASDFNLPPVVAKEIVASCDKCQLKGEAMHGQVDCSPGIWQLDCTHLEGKIILVAVHVASGYIEAEVIPAETGQETAYFLLKLAGRWPVKTI
HTDNGSNFTSTTVKAACWWAGIKQEFGIPYNPQSQGVVESMNKELKKIIGQVRDQAEHLKTAVQMAVFIHNFKRKGGIGGYSAGERIVDIIA
TDIQTKELQKQITKIQNFRVYYRDSRDPLWKGPAKLLWKGEGAVVIQDNSDIKVVPRRKAKIIRDYGKQMAGDDCVASRQDED$

Fig. 110B

2003_CON_A2 pol.OPT

TTCTTCCGCGAGAACCTGGCCTTCCAGCAGCGCGAGGCCCGCAAGTTCTCCTCCGAGCAGAACCGCGCCAACTCCCCCACCTCCCGCGAGCTGCGCAACGG
CGGCCGCGACAACCTGCTGTCCGAGGCCGGCGCCGAGGAGCAGGGCACCGTGCACTCCTGCAACTTCCCCCAGATCACCCTGTGGCAGCGCCCCCTGGTGA
CCGTGAAGATCGAGGGCCAGCTGCGCGAGGCCCTGCTGGACACCGGCGCCGACGACACCGTGCTGGAGGACATCAACCTGCCCGGCAAGTGGAAGCCCAAG
ATGATCGGCGGCATCGGCGGCTTCATCAAGGTGCGCCAGTACGACCAGATCGCCATCGAGATCTGCGGCAAGCGCGCCATCGGCACCGTGCTGGTGGGCCC
CACCCCCGTGAACATCATCGGCCGCAACATGCTGGTGCAGCTGGGCTGCACCCTGAACTTCCCCATCTCCCCCATCGAGACCGTGCCCGTGAAGCTGAAGC
CCGGCATGGACGGCCCCAAGGTGAAGCAGTGGCCCCTGACCGAGGAGAAGATCAAGGCCCTGACCGAGATCTGCAAGGAGATGGAGAAGGAGGGCAAGATC
TCCAAGATCGGCCCCGAGAACCCCTACAACACCCCCGTGTTCGCCATCAAGAAGAAGGACTCCACCAAGTGGCGCAAGCTGGTGGACTTCCGCGAGCTGAA
CAAGCGCACCCAGGACTTCTGGGAGGTGCAGCTGGGCATCCCCCACCCCGCCGGCCTGAAGAAGAAGAAGTCCGTGACCGTGCTGGACGTGGGCGACGCCT
ACTTCTCCGTGCCCCTGCACGAGGACTTCCGCAAGTACACCGCCTTCACCATCCCCTCCATCAACAACGAGACCCCCGGCATCCGCTACCAGTACAACGTG
CTGCCCCAGGGCTGGAAGGGCTCCCCCGCCATCTTCCAGTCCTCCATGACCAAGATCCTGGAGCCCTTCCGCTCCAAGAACCCCGAGATGGTGATCTACCA
GTACATGGACGACCTGTACGTGGGCTCCGACCTGGAGATCGGCCAGCACCGCGCCAAGATCGAGGAGCTGCGCGCCCACCTGCTGCGCTGGGGCTTCACCA
CCCCCGACAAGAAGCACCAGAAGGAGCCCCCCTTCCTGTGGATGGGCTACGAGCTGCACCCCGACAAGTGGACCGTGCAGCCCATCAAGCTGCCCGAGAAG
GACTCCTGGACCGTGAACGACATCCAGAAGCTGGTGGGCAAGCTGAACTGGGCCTCCCAGATCTACGCCGGCATCAAGGTGAAGCAGCTGTGCAAGCTGCT
GCGCGGCACCAAGGCCCTGACCGACATCGTGACCCTGACCAAGGAGGCCGAGCTGGAGCTGGAGGAGAACCGCGAGATCCTGAAGAACCCCGTGCACGGCG
TGTACTACGACCCCTCCAAGGACCTGATCGCCGAGATCCAGAAGCAGGGCCAGGACCAGTGGACCTACCAGATCTACCAGGAGCCCTTCAAGAACCTGAAG
ACCGGCAAGTACGCCAAGCGCAAGTCCACCCACACCAACGACGTGAAGCAGCTGACCGAGGCCGTGCAGAAGATCGCCATCGAGTCCATCGTGATCTGGGG
CAAGACCCCCAAGTTCCGCCTGCCCATCCAGAAGGAGACCTGGGAGACCTGGTGGACCGAGTACTGGCAGGCCACCTGGATCCCCGAGTGGGAGTTCGTGA
ACACCCCCCCCCTGGTGAAGCTGTGGTACCAGCTGGAGACCGAGCCCATCGCCGGCGCCGAGACCTTCTACGTGGACGGCGCCGCCAACCGCGAGACCAAG
CTGGGCAAGGCCGGCTACGTGACCGACCGCGGCCGCCAGAAGATCGTGTCCCTGACCGAGACCACCAACCAGAAGACCGAGCTGCACGCCATCTACCTGGC
CCTGCAGGACTCCGGCCTGGAGGTGAACATCGTGACCGACTCCCAGTACGCCCTGGGCATCATCCAGGCCCAGCCCGACCGCTCCGAGTCCGAGCTGGTGA
ACCAGATCATCGAGAAGCTGATCGAGAAGGAGCGCGTGTACCTGTCCTGGGTGCCCGCCCACAAGGGCATCGGCGGCAACGAGCAGGTGGACAAGCTGGTG
TCCTCCGGCATCCGCAAGGTGCTGTTCCTGGACGGCATCGACAAGGCCCAGGAGGAGCACGAGCGCTACCACTCCAACTGGCGCGCCATGGCCCACGACTT
CAACCTGCCCCCCATCGTGGCCAAGGAGATCGTGGCCTCCTGCGACAAGTGCCAGCTGAAGGGCGAGGCCATGCACGGCCAGGTGGACTGCTCCCCCGGCA
TCTGGCAGCTGGACTGCACCCACCTGGAGGGCAAGGTGATCCTGGTGGCCGTGCACGTGGCCTCCGGCTACATCGAGGCCGAGGTGATCCCCGCCGAGACC
GGCCAGGAGACCGCCTACTTCATCCTGAAGCTGGCCGGCCGCTGGCCCGTGAAGGTGATCCACACCGACAACGGCCCCAACTTCACCTCCGCCACCGTGAA
GGCCGCCTGCTGGTGGGCCGGCGTGCAGCAGGAGTTCGGCATCCCCTACAACCCCCAGTCCCAGGGCGTGGTGGAGTCCATGAACAAGGAGCTGAAGAAGA
TCATCGGCCAGGTGCGCGACCAGGCCGAGCACCTGAAGACCGCCGTGCAGATGGCCGTGTTCATCCACAACTTCAAGCGCAAGGGCGGCATCGGCGGCTAC
TCCGCCGGCGAGCGCATCATCGACATCATCGCCACCGACATCCAGACCAAGGAGCTGCAGAAGCAGATCATCAAGATCCAGAACTTCCGCGTGTACTACCG
CGACTCCCGCGACCCCATCTGGAAGGGCCCCGCCAAGCTGCTGTGGAAGGGCGAGGGCGCCGTGGTGATCCAGGACAACTCCGACATCAAGGTGGTGCCCC
GCCGCAAGGCCAAGATCATCCGCGACTACGGCAAGCAGATGGCCGGCGACGACTGCGTGGCCGGCCGCCAGGACGAGGACTAA

Fig. 111B

2003_CON_B pol.OPT

TTCTTCCGCGAGGACCTGGCCTTCCCCCAGGGCAAGGCCCGCGAGTTCTCCTCCGAGCAGACCCGCGCCAACTCCCCCACCCGCCGCGAGCTGCAGGTGTG
GGGCCGCGACAACAACTCCCTGTCCGAGGCCGGCGCCGACCGCCAGGGCACCGTGTCCTTCTCCTTCCCCCAGATCACCCTGTGGCAGCGCCCCCTGGTGA
CCATCAAGATCGGCGGCCAGCTGAAGGAGGCCCTGCTGGACACCGGCGCCGACGACACCGTGCTGGAGGAGATGAACCTGCCCGGCCGCTGGAAGCCCAAG
ATGATCGGCGGCATCGGCGGCTTCATCAAGGTGCGCCAGTACGACCAGATCCTGATCGAGATCTGCGGCCACAAGGCCATCGGCACCGTGCTGGTGGGCCC
CACCCCCGTGAACATCATCGGCCGCAACCTGCTGACCCAGATCGGCTGCACCCTGAACTTCCCCATCTCCCCCATCGAGACCGTGCCCGTGAAGCTGAAGC
CCGGCATGGACGGCCCCAAGGTGAAGCAGTGGCCCCTGACCGAGGAGAAGATCAAGGCCCTGGTGGAGATCTGCACCGAGATGGAGAAGGAGGGCAAGATC
TCCAAGATCGGCCCCGAGAACCCCTACAACACCCCCGTGTTCGCCATCAAGAAGAAGGACTCCACCAAGTGGCGCAAGCTGGTGGACTTCCGCGAGCTGAA
CAAGCGCACCCAGGACTTCTGGGAGGTGCAGCTGGGCATCCCCCACCCCGCCGGCCTGAAGAAGAAGAAGTCCGTGACCGTGCTGGACGTGGGCGACGCCT
ACTTCTCCGTGCCCCTGGACAAGGACTTCCGCAAGTACACCGCCTTCACCATCCCCTCCATCAACAACGAGACCCCCGGCATCCGCTACCAGTACAACGTG
CTGCCCCAGGGCTGGAAGGGCTCCCCCGCCATCTTCCAGTCCTCCATGACCAAGATCCTGGAGCCCTTCCGCAAGCAGAACCCCGACATCGTGATCTACCA
GTACATGGACGACCTGTACGTGGGCTCCGACCTGGAGATCGGCCAGCACCGCACCAAGATCGAGGAGCTGCGCCAGCACCTGCTGCGCTGGGGCTTCACCA
CCCCCGACAAGAAGCACCAGAAGGAGCCCCCCTTCCTGTGGATGGGCTACGAGCTGCACCCCGACAAGTGGACCGTGCAGCCCATCGTGCTGCCCGAGAAG
GACTCCTGGACCGTGAACGACATCCAGAAGCTGGTGGGCAAGCTGAACTGGGCCTCCCAGATCTACGCCGGCATCAAGGTGAAGCAGCTGTGCAAGCTGCT
GCGCGGCACCAAGGCCCTGACCGAGGTGATCCCCCTGACCGAGGAGGCCGAGCTGGAGCTGGCCGAGAACCGCGAGATCCTGAAGGAGCCCGTGCACGGCG
TGTACTACGACCCCTCCAAGGACCTGATCGCCGAGATCCAGAAGCAGGGCCAGGGCCAGTGGACCTACCAGATCTACCAGGAGCCCTTCAAGAACCTGAAG
ACCGGCAAGTACGCCCGCATGCGCGGCGCCCACACCAACGACGTGAAGCAGCTGACCGAGGCCGTGCAGAAGATCGCCACCGAGTCCATCGTGATCTGGGG
CAAGACCCCCAAGTTCAAGCTGCCCATCCAGAAGGAGACCTGGGAGGCCTGGTGGACCGAGTACTGGCAGGCCACCTGGATCCCCGAGTGGGAGTTCGTGA
ACACCCCCCCCCTGGTGAAGCTGTGGTACCAGCTGGAGAAGGAGCCCATCGTGGGCGCCGAGACCTTCTACGTGGACGGCGCCGCCAACCGCGAGACCAAG
CTGGGCAAGGCCGGCTACGTGACCGACCGCGGCCGCCAGAAGGTGGTGTCCCTGACCGACACCACCAACCAGAAGACCGAGCTGCAGGCCATCCACCTGGC
CCTGCAGGACTCCGGCCTGGAGGTGAACATCGTGACCGACTCCCAGTACGCCCTGGGCATCATCCAGGCCCAGCCCGACAAGTCCGAGTCCGAGCTGGTGT
CCCAGATCATCGAGCAGCTGATCAAGAAGGAGAAGGTGTACCTGGCCTGGGTGCCCGCCCACAAGGGCATCGGCGGCAACGAGCAGGTGGACAAGCTGGTG
TCCGCCGGCATCCGCAAGGTGCTGTTCCTGGACGGCATCGACAAGGCCCAGGAGGAGCACGAGAAGTACCACTCCAACTGGCGCGCCATGGCCTCCGACTT
CAACCTGCCCCCCGTGGTGGCCAAGGAGATCGTGGCCTCCTGCGACAAGTGCCAGCTGAAGGGCGAGGCCATGCACGGCCAGGTGGACTGCTCCCCCGGCA
TCTGGCAGCTGGACTGCACCCACCTGGAGGGCAAGATCATCCTGGTGGCCGTGCACGTGGCCTCCGGCTACATCGAGGCCGAGGTGATCCCCGCCGAGACC
GGCCAGGAGACCGCCTACTTCCTGCTGAAGCTGGCCGGCCGCTGGCCCGTGAAGACCATCCACACCGACAACGGCTCCAACTTCACCTCCACCACCGTGAA
GGCCGCCTGCTGGTGGGCCGGCATCAAGCAGGAGTTCGGCATCCCCTACAACCCCCAGTCCCAGGGCGTGGTGGAGTCCATGAACAAGGAGCTGAAGAAGA
TCATCGGCCAGGTGCGCGACCAGGCCGAGCACCTGAAGACCGCCGTGCAGATGGCCGTGTTCATCCACAACTTCAAGCGCAAGGGCGGCATCGGCGGCTAC
TCCGCCGGCGAGCGCATCGTGGACATCATCGCCACCGACATCCAGACCAAGGAGCTGCAGAAGCAGATCACCAAGATCCAGAACTTCCGCGTGTACTACCG
CGACTCCCGCGACCCCCTGTGGAAGGGCCCCGCCAAGCTGCTGTGGAAGGGCGAGGGCGCCGTGGTGATCCAGGACAACTCCGACATCAAGGTGGTGCCCC
GCCGCAAGGCCAAGATCATCCGCGACTACGGCAAGCAGATGGCCGGCGACGACTGCGTGGCCTCCCGCCAGGACGAGGACTAA

Fig. 111C

67. 2003_B.anc pol.PEP

FFRENLAFPQGKAREFSSEQTRANSPTRRELQVWGRDNNPLSEAGADRQGTVSFSFPQITLWQRPLVTIKIGGQLKEALLDTGADDTVLEEM
NLPGKWKPKMIGGIGGFIKVRQYDQILIEICGHKAIGTVLVGPTPVNIIGRNLLTQIGCTLNFPISPIETVPVKLKPGMDGPKVKQWPLTEE
KIKALVEICTEMEKEGKISKIGPENPYNTPVFAIKKKDSTKWRKLVDFRELNKRTQDFWEVQLGIPHPAGLKKKKSVTVLDVGDAYFSVPLD
KDFRKYTAFTIPSINNETPGIRYQYNVLPQGWKGSPAIFQSSMTKILEPFRKQNPEIVIYQYMDDLYVGSDLEIGQHRTKIEELREHLLRWG
FTTPDKKHQKEPPFLWMGYELHPDKWTVQPIVLPEKDSWTVNDIQKLVGKLNWASQIYAGIKVKQLCKLLRGTKALTEVVPLTEEAELELAE
NREILKEPVHGVYYDPSKDLIAEIQKQGQGQWTYQIYQEPFKNLKTGKYARMRGAHTNDVKQLTEAVQKIATESIVIWGKTPKFKLPIQKET
WEAWWTEYWQATWIPEWEFVNTPPLVKLWYQLEKEPIVGAETFYVDGAANRETKLGKAGYVTDRGRQKVVSLTDTTNQKTELQAIHLALQDS
GLEVNIVTDSQYALGIIQAQPDKSESELVSQIIEQLIKKEKVYLAWVPAHKGIGGNEQVDKLVSAGIRKVLFLDGIDKAQEEHEKYHSNWRA
MASDFNLPPVVAKEIVASCDKCQLKGEAMHGQVDCSPGIWQLDCTHLEGKIILVAVHVASGYIEAEVIPAETGQETAYFILKLAGRWPVKVI
HTDNGSNFTSTTVKAACWWAGIKQEFGIPYNPQSQGVVESMNKELKKIIGQVRDQAEHLKTAVQMAVFIHNFKRKGGIGGYSAGERIVDIIA
TDIQTKELQKQITKIQNFRVYYRDSRDPLWKGPAKLLWKGEGAVVIQDNSDIKVVPRRKAKIIRDYGKQMAGDDCVASRQDED$

Fig. 111D

2003_B.anc pol.OPT

TTCTTCCGCGAGAACCTGGCCTTCCCCCAGGGCAAGGCCCGCGAGTTCTCCTCCGAGCAGACCCGCGCCAACTCCCCCACCCGCCGCGAGCTGCAGGTGTG
GGGCCGCGACAACAACCCCCTGTCCGAGGCCGGCGCCGACCGCCAGGGCACCGTGTCCTTCTCCTTCCCCCAGATCACCCTGTGGCAGCGCCCCCTGGTGA
CCATCAAGATCGGCGGCCAGCTGAAGGAGGCCCTGCTGGACACCGGCGCCGACGACACCGTGCTGGAGGAGATGAACCTGCCCGGCAAGTGGAAGCCCAAG
ATGATCGGCGGCATCGGCGGCTTCATCAAGGTGCGCCAGTACGACCAGATCCTGATCGAGATCTGCGGCCACAAGGCCATCGGCACCGTGCTGGTGGGCCC
CACCCCCGTGAACATCATCGGCCGCAACCTGCTGACCCAGATCGGCTGCACCCTGAACTTCCCCATCTCCCCCATCGAGACCGTGCCCGTGAAGCTGAAGC
CCGGCATGGACGGCCCCAAGGTGAAGCAGTGGCCCCTGACCGAGGAGAAGATCAAGGCCCTGGTGGAGATCTGCACCGAGATGGAGAAGGAGGGCAAGATC
TCCAAGATCGGCCCCGAGAACCCCTACAACACCCCCGTGTTCGCCATCAAGAAGAAGGACTCCACCAAGTGGCGCAAGCTGGTGGACTTCCGCGAGCTGAA
CAAGCGCACCCAGGACTTCTGGGAGGTGCAGCTGGGCATCCCCCACCCCGCCGGCCTGAAGAAGAAGAAGTCCGTGACCGTGCTGGACGTGGGCGACGCCT
ACTTCTCCGTGCCCCTGGACAAGGACTTCCGCAAGTACACCGCCTTCACCATCCCCTCCATCAACAACGAGACCCCCGGCATCCGCTACCAGTACAACGTG
CTGCCCCAGGGCTGGAAGGGCTCCCCCGCCATCTTCCAGTCCTCCATGACCAAGATCCTGGAGCCCTTCCGCAAGCAGAACCCCGAGATCGTGATCTACCA
GTACATGGACGACCTGTACGTGGGCTCCGACCTGGAGATCGGCCAGCACCGCACCAAGATCGAGGAGCTGCGCGAGCACCTGCTGCGCTGGGGCTTCACCA
CCCCCGACAAGAAGCACCAGAAGGAGCCCCCCTTCCTGTGGATGGGCTACGAGCTGCACCCCGACAAGTGGACCGTGCAGCCCATCGTGCTGCCCGAGAAG
GACTCCTGGACCGTGAACGACATCCAGAAGCTGGTGGGCAAGCTGAACTGGGCCTCCCAGATCTACGCCGGCATCAAGGTGAAGCAGCTGTGCAAGCTGCT
GCGCGGCACCAAGGCCCTGACCGAGGTGGTGCCCCTGACCGAGGAGGCCGAGCTGGAGCTGGCCGAGAACCGCGAGATCCTGAAGGAGCCCGTGCACGGCG
TGTACTACGACCCCTCCAAGGACCTGATCGCCGAGATCCAGAAGCAGGGCCAGGGCCAGTGGACCTACCAGATCTACCAGGAGCCCTTCAAGAACCTGAAG
ACCGGCAAGTACGCCCGCATGCGCGGCGCCCACACCAACGACGTGAAGCAGCTGACCGAGGCCGTGCAGAAGATCGCCACCGAGTCCATCGTGATCTGGGG
CAAGACCCCCAAGTTCAAGCTGCCCATCCAGAAGGAGACCTGGGAGGCCTGGTGGACCGAGTACTGGCAGGCCACCTGGATCCCCGAGTGGGAGTTCGTGA
ACACCCCCCCCCTGGTGAAGCTGTGGTACCAGCTGGAGAAGGAGCCCATCGTGGGCGCCGAGACCTTCTACGTGGACGGCGCCGCCAACCGCGAGACCAAG
CTGGGCAAGGCCGGCTACGTGACCGACCGCGGCCGCCAGAAGGTGGTGTCCCTGACCGACACCACCAACCAGAAGACCGAGCTGCAGGCCATCCACCTGGC
CCTGCAGGACTCCGGCCTGGAGGTGAACATCGTGACCGACTCCCAGTACGCCCTGGGCATCATCCAGGCCCAGCCCGACAAGTCCGAGTCCGAGCTGGTGT
CCCAGATCATCGAGCAGCTGATCAAGAAGGAGAAGGTGTACCTGGCCTGGGTGCCCGCCCACAAGGGCATCGGCGGCAACGAGCAGGTGGACAAGCTGGTG
TCCGCCGGCATCCGCAAGGTGCTGTTCCTGGACGGCATCGACAAGGCCCAGGAGGAGCACGAGAAGTACCACTCCAACTGGCGCGCCATGGCCTCCGACTT
CAACCTGCCCCCCGTGGTGGCCAAGGAGATCGTGGCCTCCTGCGACAAGTGCCAGCTGAAGGGCGAGGCCATGCACGGCCAGGTGGACTGCTCCCCCGGCA
TCTGGCAGCTGGACTGCACCCACCTGGAGGGCAAGATCATCCTGGTGGCCGTGCACGTGGCCTCCGGCTACATCGAGGCCGAGGTGATCCCCGCCGAGACC
GGCCAGGAGACCGCCTACTTCATCCTGAAGCTGGCCGGCCGCTGGCCCGTGAAGGTGATCCACACCGACAACGGCTCCAACTTCACCTCCACCACCGTGAA
GGCCGCCTGCTGGTGGGCCGGCATCAAGCAGGAGTTCGGCATCCCCTACAACCCCCAGTCCCAGGGCGTGGTGGAGTCCATGAACAAGGAGCTGAAGAAGA
TCATCGGCCAGGTGCGCGACCAGGCCGAGCACCTGAAGACCGCCGTGCAGATGGCCGTGTTCATCCACAACTTCAAGCGCAAGGGCGGCATCGGCGGCTAC
TCCGCCGGCGAGCGCATCGTGGACATCATCGCCACCGACATCCAGACCAAGGAGCTGCAGAAGCAGATCACCAAGATCCAGAACTTCCGCGTGTACTACCG
CGACTCCCGCGACCCCCTGTGGAAGGGCCCCGCCAAGCTGCTGTGGAAGGGCGAGGGCGCCGTGGTGATCCAGGACAACTCCGACATCAAGGTGGTGCCCC
GCCGCAAGGCCAAGATCATCCGCGACTACGGCAAGCAGATGGCCGGCGACGACTGCGTGGCCTCCCGCCAGGACGAGGACTAA

Fig. 112A

68. 2003_CON_C pol.PEP

FFRENLAFPQGEAREFPSEQTRANSPTSRELQVRGDNPRSEAGAERQGTLNFPQITLWQRPLVSIKVGGQIKEALLDTGADDTVLEEINLPG
KWKPKMIGGIGGFIKVRQYDQILIEICGKKAIGTVLVGPTPVNIIGRNMLTQLGCTLNFPISPIETVPVKLKPGMDGPKVKQWPLTEEKIKA
LTAICEEMEKEGKITKIGPENPYNTPVFAIKKKDSTKWRKLVDFRELNKRTQDFWEVQLGIPHPAGLKKKKSVTVLDVGDAYFSVPLDEGFR
KYTAFTIPSINNETPGIRYQYNVLPQGWKGSPAIFQSSMTKILEPFRAQNPEIVIYQYMDDLYVGSDLEIGQHRAKIEELREHLLKWGFTTP
DKKHQKEPPFLWMGYELHPDKWTVQPIQLPEKDSWTVNDIQKLVGKLNWASQIYPGIKVRQLCKLLRGAKALTDIVPLTEEAELELAENREI
LKEPVHGVYYDPSKDLIAEIQKQGHDQWTYQIYQEPFKNLKTGKYAKMRTAHTNDVKQLTEAVQKIAMESIVIWGKTPKFRLPIQKETWETW
WTDYWQATWIPEWEFVNTPPLVKLWYQLEKEPIAGAETFYVDGAANRETKIGKAGYVTDRGRQKIVSLTETTNQKTELQAIQLALQDSGSEV
NIVTDSQYALGIIQAQPDKSESELVNQIIEQLIKKERVYLSWVPAHKGIGGNEQVDKLVSSGIRKVLFLDGIDKAQEEHEKYHSNWRAMASE
FNLPPIVAKEIVASCDKCQLKGEAIHGQVDCSPGIWQLDCTHLEGKIILVAVHVASGYIEAEVIPAETGQETAYYILKLAGRWPVKVIHTDN
GSNFTSAAVKAACWWAGIQQEFGIPYNPQSQGVVESMNKELKKIIGQVRDQAEHLKTAVQMAVFIHNFKRKGGIGGYSAGERIIDIIATDIQ
TKELQKQIIKIQNFRVYYRDSRDPIWKGPAKLLWKGEGAVVIQDNSDIKVVPRRKAKIIKDYGKQMAGADCVAGRQDED$

Fig. 112B

2003_CON_C pol.OPT

TTCTTCCGCGAGAACCTGGCCTTCCCCCAGGGCGAGGCCCGCGAGTTCCCCTCCGAGCAGACCCGCGCCAACTCCCCCACCTCCCGCGAGCTGCAGGTGCG
CGGCGACAACCCCCGCTCCGAGGCCGGCGCCGAGCGCCAGGGCACCCTGAACTTCCCCCAGATCACCCTGTGGCAGCGCCCCCTGGTGTCCATCAAGGTGG
GCGGCCAGATCAAGGAGGCCCTGCTGGACACCGGCGCCGACGACACCGTGCTGGAGGAGATCAACCTGCCCGGCAAGTGGAAGCCCAAGATGATCGGCGGC
ATCGGCGGCTTCATCAAGGTGCGCCAGTACGACCAGATCCTGATCGAGATCTGCGGCAAGAAGGCCATCGGCACCGTGCTGGTGGGCCCCACCCCCGTGAA
CATCATCGGCCGCAACATGCTGACCCAGCTGGGCTGCACCCTGAACTTCCCCATCTCCCCCATCGAGACCGTGCCCGTGAAGCTGAAGCCCGGCATGGACG
GCCCCAAGGTGAAGCAGTGGCCCCTGACCGAGGAGAAGATCAAGGCCCTGACCGCCATCTGCGAGGAGATGGAGAAGGAGGGCAAGATCACCAAGATCGGC
CCCGAGAACCCCTACAACACCCCCGTGTTCGCCATCAAGAAGAAGGACTCCACCAAGTGGCGCAAGCTGGTGGACTTCCGCGAGCTGAACAAGCGCACCCA
GGACTTCTGGGAGGTGCAGCTGGGCATCCCCCACCCCGCCGGCCTGAAGAAGAAGAAGTCCGTGACCGTGCTGGACGTGGGCGACGCCTACTTCTCCGTGC
CCCTGGACGAGGGCTTCCGCAAGTACACCGCCTTCACCATCCCCTCCATCAACAACGAGACCCCCGGCATCCGCTACCAGTACAACGTGCTGCCCCAGGGC
TGGAAGGGCTCCCCCGCCATCTTCCAGTCCTCCATGACCAAGATCCTGGAGCCCTTCCGCGCCCAGAACCCCGAGATCGTGATCTACCAGTACATGGACGA
CCTGTACGTGGGCTCCGACCTGGAGATCGGCCAGCACCGCGCCAAGATCGAGGAGCTGCGCGAGCACCTGCTGAAGTGGGGCTTCACCACCCCCGACAAGA
AGCACCAGAAGGAGCCCCCCTTCCTGTGGATGGGCTACGAGCTGCACCCCGACAAGTGGACCGTGCAGCCCATCCAGCTGCCCGAGAAGGACTCCTGGACC
GTGAACGACATCCAGAAGCTGGTGGGCAAGCTGAACTGGGCCTCCCAGATCTACCCCGGCATCAAGGTGCGCCAGCTGTGCAAGCTGCTGCGCGGCGCCAA
GGCCCTGACCGACATCGTGCCCCTGACCGAGGAGGCCGAGCTGGAGCTGGCCGAGAACCGCGAGATCCTGAAGGAGCCCGTGCACGGCGTGTACTACGACC
CCTCCAAGGACCTGATCGCCGAGATCCAGAAGCAGGGCCACGACCAGTGGACCTACCAGATCTACCAGGAGCCCTTCAAGAACCTGAAGACCGGCAAGTAC
GCCAAGATGCGCACCGCCCACACCAACGACGTGAAGCAGCTGACCGAGGCCGTGCAGAAGATCGCCATGGAGTCCATCGTGATCTGGGGCAAGACCCCCAA
GTTCCGCCTGCCCATCCAGAAGGAGACCTGGGAGACCTGGTGGACCGACTACTGGCAGGCCACCTGGATCCCCGAGTGGGAGTTCGTGAACACCCCCCCC
TGGTGAAGCTGTGGTACCAGCTGGAGAAGGAGCCCATCGCCGGCGCCGAGACCTTCTACGTGGACGGCGCCGCCAACCGCGAGACCAAGATCGGCAAGGCC
GGCTACGTGACCGACCGCGGCCGCCAGAAGATCGTGTCCCTGACCGAGACCACCAACCAGAAGACCGAGCTGCAGGCCATCCAGCTGGCCCTGCAGGACTC
CGGCTCCGAGGTGAACATCGTGACCGACTCCCAGTACGCCCTGGGCATCATCCAGGCCCAGCCCGACAAGTCCGAGTCCGAGCTGGTGAACCAGATCATCG
AGCAGCTGATCAAGAAGGAGCGCGTGTACCTGTCCTGGGTGCCCGCCCACAAGGGCATCGGCGGCAACGAGCAGGTGGACAAGCTGGTGTCCTCCGGCATC
CGCAAGGTGCTGTTCCTGGACGGCATCGACAAGGCCCAGGAGGAGCACGAGAAGTACCACTCCAACTGGCGCGCCATGGCCTCCGAGTTCAACCTGCCCCC
CATCGTGGCCAAGGAGATCGTGGCCTCCTGCGACAAGTGCCAGCTGAAGGGCGAGGCCATCCACGGCCAGGTGGACTGCTCCCCCGGCATCTGGCAGCTGG
ACTGCACCCACCTGGAGGGCAAGATCATCCTGGTGGCCGTGCACGTGGCCTCCGGCTACATCGAGGCCGAGGTGATCCCCGCCGAGACCGGCCAGGAGACC
GCCTACTACATCCTGAAGCTGGCCGGCCGCTGGCCCGTGAAGGTGATCCACACCGACAACGGCTCCAACTTCACCTCCGCCGCCGTGAAGGCCGCCTGCTG
GTGGGCCGGCATCCAGCAGGAGTTCGGCATCCCCTACAACCCCCAGTCCCAGGGCGTGGTGGAGTCCATGAACAAGGAGCTGAAGAAGATCATCGGCCAGG
TGCGCGACCAGGCCGAGCACCTGAAGACCGCCGTGCAGATGGCCGTGTTCATCCACAACTTCAAGCGCAAGGGCGGCATCGGCGGCTACTCCGCCGGCGAG
CGCATCATCGACATCATCGCCACCGACATCCAGACCAAGGAGCTGCAGAAGCAGATCATCAAGATCCAGAACTTCCGCGTGTACTACCGCGACTCCCGCGA
CCCCATCTGGAAGGGCCCCGCCAAGCTGCTGTGGAAGGGCGAGGGCGCCGTGGTGATCCAGGACAACTCCGACATCAAGGTGGTGCCCCGCCGCAAGGCCA
AGATCATCAAGGACTACGGCAAGCAGATGGCCGGCGCCGACTGCGTGGCCGGCCGCCAGGACGAGGACTAA

*Fig. 112C*

69. 2003_C.anc pol.PEP

FFRENLAFPQGEAREFPSEQTRANSPTSRELQVGRDNPRSEAGAERQGTLTLNFPQITLWQRPLVSIKVGGQIKEALLDTGADDTVLEEINL
PGKWKPKMIGGIGGFIKVRQYDQILIEICGKKAIGTVLVGPTPVNIIGRNMLTQLGCTLNFPISPIETVPVKLKPGMDGPKVKQWPLTEEKI
KALTAICEEMEKEGKITKIGPENPYNTPVFAIKKKDSTKWRKLVDFRELNKRTQDFWEVQLGIPHPAGLKKKKSVTVLDVGDAYFSVPLDEG
FRKYTAFTIPSINNETPGIRYQYNVLPQGWKGSPAIFQSSMTKILEPFRAQNPEIVIYQYMDDLYVGSDLEIGQHRAKIEELREHLLKWGFT
TPDKKHQKEPPFLWMGYELHPDKWTVQPIQLPEKDSWTVNDIQKLVGKLNWASQIYPGIKVRQLCKLLRGAKALTDIVPLTEEAELELAENR
EILKEPVHGVYYDPSKDLIAEIQKQGHDQWTYQIYQEPFKNLKTGKYAKMRTAHTNDVKQLTEAVQKIAMESIVIWGKTPKFRLPIQKETWE
TWWTDYWQATWIPEWEFVNTPPLVKLWYQLEKEPIAGAETFYVDGAANRETKIGKAGYVTDRGRQKIVSLTETTNQKTELQAIQLALQDSGS
EVNIVTDSQYALGIIQAQPDKSESELVNQIIEQLIKKEKVYLSWVPAHKGIGGNEQVDKLVSSGIRKVLFLDGIDKAQEEHEKYHSNWRAMA
SEFNLPPIVAKEIVASCDKCQLKGEAMHGQVDCSPGIWQLDCTHLEGKIILVAVHVASGYIEAEVIPAETGQETAYFILKLAGRWPVKVIHT
DNGSNFTSAAVKAACWWAGIQQEFGIPYNPQSQGVVESMNKELKKIIGQVRDQAEHLKTAVQMAVFIHNFKRKGGIGGYSAGERIIDIIATD
IQTKELQKQIIKIQNFRVYYRDSRDPIWKGPAKLLWKGEGAVVIQDNSDIKVVPRRKAKIIRDYGKQMAGADCVAGRQDED$

Fig. 112D

2003_C.anc pol.OPT

TTCTTCCGCGAGAACCTGGCCTTCCCCCAGGGCGAGGCCCGCGAGTTCCCCTCCGAGCAGACCCGCGCCAACTCCCCCACCTCCCGCGAGCTGCAGGTGGG
CCGCGACAACCCCCGCTCCGAGGCCGGCGCCGAGCGCCAGGGCACCCTGACCCTGAACTTCCCCCAGATCACCCTGTGGCAGCGCCCCCTGGTGTCCATCA
AGGTGGGCGGCCAGATCAAGGAGGCCCTGCTGGACACCGGCGCCGACGACACCGTGCTGGAGGAGATCAACCTGCCCGGCAAGTGGAAGCCCAAGATGATC
GGCGGCATCGGCGGCTTCATCAAGGTGCGCCAGTACGACCAGATCCTGATCGAGATCTGCGGCAAGAAGGCCATCGGCACCGTGCTGGTGGGCCCCACCCC
CGTGAACATCATCGGCCGCAACATGCTGACCCAGCTGGGCTGCACCCTGAACTTCCCCATCTCCCCCATCGAGACCGTGCCCGTGAAGCTGAAGCCCGGCA
TGGACGGCCCCAAGGTGAAGCAGTGGCCCCTGACCGAGGAGAAGATCAAGGCCCTGACCGCCATCTGCGAGGAGATGGAGAAGGAGGGCAAGATCACCAAG
ATCGGCCCCGAGAACCCCTACAACACCCCCGTGTTCGCCATCAAGAAGAAGGACTCCACCAAGTGGCGCAAGCTGGTGGACTTCCGCGAGCTGAACAAGCG
CACCCAGGACTTCTGGGAGGTGCAGCTGGGCATCCCCCACCCCGCCGGCCTGAAGAAGAAGAAGTCCGTGACCGTGCTGGACGTGGGCGACGCCTACTTCT
CCGTGCCCCTGGACGAGGGCTTCCGCAAGTACACCGCCTTCACCATCCCCTCCATCAACAACGAGACCCCCGGCATCCGCTACCAGTACAACGTGCTGCCC
CAGGGCTGGAAGGGCTCCCCCGCCATCTTCCAGTCCTCCATGACCAAGATCCTGGAGCCCTTCCGCGCCCAGAACCCCGAGATCGTGATCTACCAGTACAT
GGACGACCTGTACGTGGGCTCCGACCTGGAGATCGGCCAGCACCGCGCCAAGATCGAGGAGCTGCGCGAGCACCTGCTGAAGTGGGGCTTCACCACCCCCG
ACAAGAAGCACCAGAAGGAGCCCCCCTTCCTGTGGATGGGCTACGAGCTGCACCCCGACAAGTGGACCGTGCAGCCCATCCAGCTGCCCGAGAAGGACTCC
TGGACCGTGAACGACATCCAGAAGCTGGTGGGCAAGCTGAACTGGGCCTCCCAGATCTACCCCGGCATCAAGGTGCGCCAGCTGTGCAAGCTGCTGCGCGG
CGCCAAGGCCCTGACCGACATCGTGCCCCTGACCGAGGAGGCCGAGCTGGAGCTGGCCGAGAACCGCGAGATCCTGAAGGAGCCCGTGCACGGCGTGTACT
ACGACCCCTCCAAGGACCTGATCGCCGAGATCCAGAAGCAGGGCCACGACCAGTGGACCTACCAGATCTACCAGGAGCCCTTCAAGAACCTGAAGACCGGC
AAGTACGCCAAGATGCGCACCGCCCACACCAACGACGTGAAGCAGCTGACCGAGGCCGTGCAGAAGATCGCCATGGAGTCCATCGTGATCTGGGGCAAGAC
CCCCAAGTTCCGCCTGCCCATCCAGAAGGAGACCTGGGAGACCTGGTGGACCGACTACTGGCAGGCCACCTGGATCCCCGAGTGGGAGTTCGTGAACACCC
CCCCCCTGGTGAAGCTGTGGTACCAGCTGGAGAAGGAGCCCATCGCCGGCGCCGAGACCTTCTACGTGGACGGCGCCGCCAACCGCGAGACCAAGATCGGC
AAGGCCGGCTACGTGACCGACCGCGGCCGCCAGAAGATCGTGTCCCTGACCGAGACCACCAACCAGAAGACCGAGCTGCAGGCCATCCAGCTGGCCCTGCA
GGACTCCGGCTCCGAGGTGAACATCGTGACCGACTCCCAGTACGCCCTGGGCATCATCCAGGCCCAGCCCGACAAGTCCGAGTCCGAGCTGGTGAACCAGA
TCATCGAGCAGCTGATCAAGAAGGAGAAGGTGTACCTGTCCTGGGTGCCCGCCCACAAGGGCATCGGCGGCAACGAGCAGGTGGACAAGCTGGTGTCCTCC
GGCATCCGCAAGGTGCTGTTCCTGGACGGCATCGACAAGGCCCAGGAGGAGCACGAGAAGTACCACTCCAACTGGCGCGCCATGGCCTCCGAGTTCAACCT
GCCCCCCATCGTGGCCAAGGAGATCGTGGCCTCCTGCGACAAGTGCCAGCTGAAGGGCGAGGCCATGCACGGCCAGGTGGACTGCTCCCCCGGCATCTGGC
AGCTGGACTGCACCCACCTGGAGGGCAAGATCATCCTGGTGGCCGTGCACGTGGCCTCCGGCTACATCGAGGCCGAGGTGATCCCCGCCGAGACCGGCCAG
GAGACCGCCTACTTCATCCTGAAGCTGGCCGGCCGCTGGCCCGTGAAGGTGATCCACACCGACAACGGCTCCAACTTCACCTCCGCCGCCGTGAAGGCCGC
CTGCTGGTGGGCCGGCATCCAGCAGGAGTTCGGCATCCCCTACAACCCCCAGTCCCAGGGCGTGGTGGAGTCCATGAACAAGGAGCTGAAGAAGATCATCG
GCCAGGTGCGCGACCAGGCCGAGCACCTGAAGACCGCCGTGCAGATGGCCGTGTTCATCCACAACTTCAAGCGCAAGGGCGGCATCGGCGGCTACTCCGCC
GGCGAGCGCATCATCGACATCATCGCCACCGACATCCAGACCAAGGAGCTGCAGAAGCAGATCATCAAGATCCAGAACTTCCGCGTGTACTACCGCGACTC
CCGCGACCCCATCTGGAAGGGCCCCGCCAAGCTGCTGTGGAAGGGCGAGGGCGCCGTGGTGATCCAGGACAACTCCGACATCAAGGTGGTGCCCCGCCGCA
AGGCCAAGATCATCCGCGACTACGGCAAGCAGATGGCCGGCGCCGACTGCGTGGCCGGCGCCAGGACGAGGACTAA

Fig. 113A

70. 2003_CON_D pol.PEP

FFRENLAFPQGKAGELSSEQTRANSPTSRELRVWGGDNPLSETGAERQGTVSFNFPQITLWQRPLVTIKIGGQLKEALLDTGADDTVLEEIN
LPGKWKPKMIGGIGGFIKVRQYDQILIEICGHKAIGTVLVGPTPVNIIGRNLLTQIGCTLNFPISPIETVPVKLKPGMDGPKVKQWPLTEEK
IKALTEICTEMEKEGKISRIGPENPYNTPIFAIKKKDSTKWRKLVDFRELNKRTQDFWEVQLGIPHPAGLKKKKSVTVLDVGDAYFSVPLDE
DFRKYTAFTIPSINNETPGIRYQYNVLPQGWKGSPAIFQSSMTKILEPFRKQNPEIVIYQYMDDLYVGSDLEIGQHRTKIEELREHLLRWGF
TTPDKKHQKEPPFLWMGYELHPDKWTVQPIKLPEKESWTVNDIQKLVGKLNWASQIYPGIKVRQLCKLLRGTKALTEVIPLTEEAELELAEN
REILKEPVHGVYYDPSKDLIAEIQKQGQGQWTYQIYQEPFKNLKTGKYARMRGAHTNDVKQLTEAVQKIAIESIVIWGKTPKFRLPIQKETW
ETWWTEYWQATWIPEWEFVNTPPLVKLWYQLEKEPIIGAETFYVDGAANRETKLGKAGYVTDRGRQKVVPLTDTTNQKTELQAINLALQDSG
LEVNIVTDSQYALGIIQAQPDKSESELVSQIIEQLIKKEKVYLAWVPAHKGIGGNEQVDKLVSNGIRKVLFLDGIDKAQEEHEKYHNNWRAM
ASDFNLPPVVAKEIVASCDKCQLKGEAMHGQVDCSPGIWQLDCTHLEGKVILVAVHVASGYIEAEVIPAETGQETAYFLLKLAGRWPVKVVH
TDNGSNFTSAAVKAACWWAGIKQEFGIPYNPQSQGVVESMNKELKKIIGQVRDQAEHLKTAVQMAVFIHNFKRKGGIGGYSAGERIIDIIAT
DIQTKELQKQIIKIQNFRVYYRDSRDPIWKGPAKLLWKGEGAVVIQDNSDIKVVPRRKVKIIRDYGKQMAGDDCVASRQDED$

Fig. 114A

71. 2003_CON_F1 pol.PEP

FFRENLAFQQGEARKFPSEQTRANSPASRELRVQRGDNPLSEAGAERRGTVPSLSFPQITLWQRPLVTIKIGGQLKEALLDTGADDTVLEDI
NLPGKWKPKMIGGIGGFIKVKQYDHILIEICGHKAIGTVLVGPTPVNIIGRNMLTQIGCTLNFPISPIETVPVKLKPGMDGPKVKQWPLTEE
KIKALTEICTEMEKEGKISKIGPENPYNTPVFAIKKKDSTKWRKLVDFRELNKRTQDFWEVQLGIPHPAGLKKKKSVTVLDVGDAYFSVPLD
KDFRKYTAFTIPSVNNETPGIRYQYNVLPQGWKGSPAIFQCSMTKILEPFRTKNPDIVIYQYMDDLYVGSDLEIGQHRTKIEELREHLLKWG
FTTPDKKHQKEPPFLWMGYELHPDKWTVQPIQLPDKDSWTVNDIQKLVGKLNWASQIYPGIKVKQLCKLLRGAKALTDIVPLTAEAELELAE
NREILKEPVHGVYYDPSKDLIAEIQKQGQGQWTYQIYQEPFKNLKTGKYAKMRSAHTNDVKQLTEAVQKIALESIVIWGKTPKFRLPILKET
WDTWWTDYWQATWIPEWEFVNTPPLVKLWYQLETEPIVGAETFYVDGASNRETKKGKAGYVTDRGRQKVVSLTETTNQKAELQAIHLALQDS
GSEVNIVTDSQYALGIIQAQPDKSESELVNQIIEQLIQKEKVYLSWVPAHKGIGGNEQVDKLVSAGIRKILFLDGIDKAQEEHEKYHNNWRA
MASDFNLPPVVAKEIVASCDKCQLKGEAMHGQVDCSPGIWQLDCTHLEGKIILVAVHVASGYIEAEVIPAETGQETAYFILKLAGRWPVKII
HTDNGSNFTSAAVKAACWWAGIQQEFGIPYNPQSQGVVESMNKELKKIIGQVRDQAEHLKTAVQMAVFIHNFKRKGGIGGYSAGERIIDIIA
TDIQTRELQKQITKIQNFRVYYRDSRDPVWKGPAKLLWKGEGAVVIQDNSEIKVVPRRKAKIIRDYGKQMAGDDCVAGRQDED$

Fig. 113B

2003_CON_D pol.OPT

TTCTTCCGCGAGAACCTGGCCTTCCCCCAGGGCAAGGCCGGCGAGCTGTCCTCCGAGCAGACCCGCGCCAACTCCCCCACCTCCCGCGAGCTGCGCGTGTG
GGGCGGCGACAACCCCCTGTCCGAGACCGGCGCCGAGCGCCAGGGCACCGTGTCCTTCAACTTCCCCCAGATCACCCTGTGGCAGCGCCCCCTGGTGACCA
TCAAGATCGGCGGCCAGCTGAAGGAGGCCCTGCTGGACACCGGCGCCGACGACACCGTGCTGGAGGAGATCAACCTGCCCGGCAAGTGGAAGCCCAAGATG
ATCGGCGGCATCGGCGGCTTCATCAAGGTGCGCCAGTACGACCAGATCCTGATCGAGATCTGCGGCCACAAGGCCATCGGCACCGTGCTGGTGGGCCCCAC
CCCCGTGAACATCATCGGCCGCAACCTGCTGACCCAGATCGGCTGCACCCTGAACTTCCCCATCTCCCCCATCGAGACCGTGCCCGTGAAGCTGAAGCCCG
GCATGGACGGCCCCAAGGTGAAGCAGTGGCCCCTGACCGAGGAGAAGATCAAGGCCCTGACCGAGATCTGCACCGAGATGGAGAAGGAGGGCAAGATCTCC
CGCATCGGCCCCGAGAACCCCTACAACACCCCCATCTTCGCCATCAAGAAGAAGGACTCCACCAAGTGGCGCAAGCTGGTGGACTTCCGCGAGCTGAACAA
GCGCACCCAGGACTTCTGGGAGGTGCAGCTGGGCATCCCCCACCCCGCCGGCCTGAAGAAGAAGAAGTCCGTGACCGTGCTGGACGTGGGCGACGCCTACT
TCTCCGTGCCCCTGGACGAGGACTTCCGCAAGTACACCGCCTTCACCATCCCCTCCATCAACAACGAGACCCCCGGCATCCGCTACCAGTACAACGTGCTG
CCCCAGGGCTGGAAGGGCTCCCCCGCCATCTTCCAGTCCTCCATGACCAAGATCCTGGAGCCCTTCCGCAAGCAGAACCCCGAGATCGTGATCTACCAGTA
CATGGACGACCTGTACGTGGGCTCCGACCTGGAGATCGGCCAGCACCGCACCAAGATCGAGGAGCTGCGCGAGCACCTGCTGCGCTGGGGCTTCACCACCC
CCGACAAGAAGCACCAGAAGGAGCCCCCCTTCCTGTGGATGGGCTACGAGCTGCACCCCGACAAGTGGACCGTGCAGCCCATCAAGCTGCCCGAGAAGGAG
TCCTGGACCGTGAACGACATCCAGAAGCTGGTGGGCAAGCTGAACTGGGCCTCCCAGATCTACCCCGGCATCAAGGTGCGCCAGCTGTGCAAGCTGCTGCG
CGGCACCAAGGCCCTGACCGAGGTGATCCCCCTGACCGAGGAGGCCGAGCTGGAGCTGGCCGAGAACCGCGAGATCCTGAAGGAGCCCGTGCACGGCGTGT
ACTACGACCCCTCCAAGGACCTGATCGCCGAGATCCAGAAGCAGGGCCAGGGCCAGTGGACCTACCAGATCTACCAGGAGCCCTTCAAGAACCTGAAGACC
GGCAAGTACGCCCGCATGCGCGGCGCCCACACCAACGACGTGAAGCAGCTGACCGAGGCCGTGCAGAAGATCGCCATCGAGTCCATCGTGATCTGGGGCAA
GACCCCCAAGTTCCGCCTGCCCATCCAGAAGGAGACCTGGGAGACCTGGTGGACCGAGTACTGGCAGGCCACCTGGATCCCCGAGTGGGAGTTCGTGAACA
CCCCCCCCCTGGTGAAGCTGTGGTACCAGCTGGAGAAGGAGCCCATCATCGGCGCCGAGACCTTCTACGTGGACGGCGCCGCCAACCGCGAGACCAAGCTG
GGCAAGGCCGGCTACGTGACCGACCGCGGCCGCCAGAAGGTGGTGCCCCTGACCGACACCACCAACCAGAAGACCGAGCTGCAGGCCATCAACCTGGCCCT
GCAGGACTCCGGCCTGGAGGTGAACATCGTGACCGACTCCCAGTACGCCCTGGGCATCATCCAGGCCCAGCCCGACAAGTCCGAGTCCGAGCTGGTGTCCC
AGATCATCGAGCAGCTGATCAAGAAGGAGAAGGTGTACCTGGCCTGGGTGCCCGCCCACAAGGGCATCGGCGGCAACGAGCAGGTGGACAAGCTGGTGTCC
AACGGCATCCGCAAGGTGCTGTTCCTGGACGGCATCGACAAGGCCCAGGAGGAGCACGAGAAGTACCACAACAACTGGCGCGCCATGGCCTCCGACTTCAA
CCTGCCCCCCGTGGTGGCCAAGGAGATCGTGGCCTCCTGCGACAAGTGCCAGCTGAAGGGCGAGGCCATGCACGGCCAGGTGGACTGCTCCCCCGGCATCT
GGCAGCTGGACTGCACCCACCTGGAGGGCAAGGTGATCCTGGTGGCCGTGCACGTGGCCTCCGGCTACATCGAGGCCGAGGTGATCCCCGCCGAGACCGGC
CAGGAGACCGCCTACTTCCTGCTGAAGCTGGCCGGCCGCTGGCCCGTGAAGGTGGTGCACACCGACAACGGCTCCAACTTCACCTCCGCCGCCGTGAAGGC
CGCCTGCTGGTGGGCCGGCATCAAGCAGGAGTTCGGCATCCCCTACAACCCCCAGTCCCAGGGCGTGGTGGAGTCCATGAACAAGGAGCTGAAGAAGATCA
TCGGCCAGGTGCGCGACCAGGCCGAGCACCTGAAGACCGCCGTGCAGATGGCCGTGTTCATCCACAACTTCAAGCGCAAGGGCGGCATCGGCGGCTACTCC
GCCGGCGAGCGCATCATCGACATCATCGCCACCGACATCCAGACCAAGGAGCTGCAGAAGCAGATCATCAAGATCCAGAACTTCCGCGTGTACTACCGCGA
CTCCCGCGACCCCATCTGGAAGGGCCCCGCCAAGCTGCTGTGGAAGGGCGAGGGCGCCGTGGTGATCCAGGACAACTCCGACATCAAGGTGGTGCCCCGCC
GCAAGGTGAAGATCATCCGCGACTACGGCAAGCAGATGGCCGGCGACGACTGCGTGGCCTCCCGCCAGGACGAGGACTAA

Fig. 114B

2003_CON_F1 pol.OPT

TTCTTCCGCGAGAACCTGGCCTTCCAGCAGGGCGAGGCCCGCAAGTTCCCCTCCGAGCAGACCCGCGCCAACTCCCCCGCCTCCCGCGAGCTGCGCGTGCA
GCGCGGCGACAACCCCCTGTCCGAGGCCGGCGCCGAGCGCCGCGGCACCGTGCCCTCCCTGTCCTTCCCCCAGATCACCCTGTGGCAGCGCCCCCTGGTGA
CCATCAAGATCGGCGGCCAGCTGAAGGAGGCCCTGCTGGACACCGGCGCCGACGACACCGTGCTGGAGGACATCAACCTGCCCGGCAAGTGGAAGCCCAAG
ATGATCGGCGGCATCGGCGGCTTCATCAAGGTGAAGCAGTACGACCACATCCTGATCGAGATCTGCGGCCACAAGGCCATCGGCACCGTGCTGGTGGGCCC
CACCCCCGTGAACATCATCGGCCGCAACATGCTGACCCAGATCGGCTGCACCCTGAACTTCCCCATCTCCCCCATCGAGACCGTGCCCGTGAAGCTGAAGC
CCGGCATGGACGGCCCCAAGGTGAAGCAGTGGCCCCTGACCGAGGAGAAGATCAAGGCCCTGACCGAGATCTGCACCGAGATGGAGAAGGAGGGCAAGATC
TCCAAGATCGGCCCCGAGAACCCCTACAACACCCCCGTGTTCGCCATCAAGAAGAAGGACTCCACCAAGTGGCGCAAGCTGGTGGACTTCCGCGAGCTGAA
CAAGCGCACCCAGGACTTCTGGGAGGTGCAGCTGGGCATCCCCCACCCCGCCGGCCTGAAGAAGAAGAAGTCCGTGACCGTGCTGGACGTGGGCGACGCCT
ACTTCTCCGTGCCCCTGGACAAGGACTTCCGCAAGTACACCGCCTTCACCATCCCCTCCGTGAACAACGAGACCCCCGGCATCCGCTACCAGTACAACGTG
CTGCCCCAGGGCTGGAAGGGCTCCCCCGCCATCTTCCAGTGCTCCATGACCAAGATCCTGGAGCCCTTCCGCACCAAGAACCCCGACATCGTGATCTACCA
GTACATGGACGACCTGTACGTGGGCTCCGACCTGGAGATCGGCCAGCACCGCACCAAGATCGAGGAGCTGCGCGAGCACCTGCTGAAGTGGGGCTTCACCA
CCCCCGACAAGAAGCACCAGAAGGAGCCCCCTTCCTGTGGATGGGCTACGAGCTGCACCCCGACAAGTGGACCGTGCAGCCCATCCAGCTGCCCGACAAG
GACTCCTGGACCGTGAACGACATCCAGAAGCTGGTGGGCAAGCTGAACTGGGCCTCCCAGATCTACCCCGGCATCAAGGTGAAGCAGCTGTGCAAGCTGCT
GCGCGGCGCCAAGGCCCTGACCGACATCGTGCCCCTGACCGCCGAGGCCGAGCTGGAGCTGGCCGAGAACCGCGAGATCCTGAAGGAGCCCGTGCACGGCG
TGTACTACGACCCCTCCAAGGACCTGATCGCCGAGATCCAGAAGCAGGGCCAGGGCCAGTGGACCTACCAGATCTACCAGGAGCCCTTCAAGAACCTGAAG
ACCGGCAAGTACGCCAAGATGCGCTCCGCCCACACCAACGACGTGAAGCAGCTGACCGAGGCCGTGCAGAAGATCGCCCTGGAGTCCATCGTGATCTGGGG
CAAGACCCCCAAGTTCCGCCTGCCCATCCTGAAGGAGACCTGGGACACCTGGTGGACCGACTACTGGCAGGCCACCTGGATCCCCGAGTGGGAGTTCGTGA
ACACCCCCCCCCTGGTGAAGCTGTGGTACCAGCTGGAGACCGAGCCCATCGTGGGCGCCGAGACCTTCTACGTGGACGGCGCCTCCAACCGCGAGACCAAG
AAGGGCAAGGCCGGCTACGTGACCGACCGCGGCCGCCAGAAGGTGGTGTCCCTGACCGAGACCACCAACCAGAAGGCCGAGCTGCAGGCCATCCACCTGGC
CCTGCAGGACTCCGGCTCCGAGGTGAACATCGTGACCGACTCCCAGTACGCCCTGGGCATCATCCAGGCCCAGCCCGACAAGTCCGAGTCCGAGCTGGTGA
ACCAGATCATCGAGCAGCTGATCCAGAAGGAGAAGGTGTACCTGTCCTGGGTGCCCGCCCACAAGGGCATCGGCGGCAACGAGCAGGTGGACAAGCTGGTG
TCCGCCGGCATCCGCAAGATCCTGTTCCTGGACGGCATCGACAAGGCCCAGGAGGAGCACGAGAAGTACCACAACAACTGGCGCGCCATGGCCTCCGACTT
CAACCTGCCCCCCGTGGTGGCCAAGGAGATCGTGGCCTCCTGCGACAAGTGCCAGCTGAAGGGCGAGGCCATGCACGGCCAGGTGGACTGCTCCCCCGGCA
TCTGGCAGCTGGACTGCACCCACCTGGAGGGCAAGATCATCCTGGTGGCCGTGCACGTGGCCTCCGGCTACATCGAGGCCGAGGTGATCCCCGCCGAGACC
GGCCAGGAGACCGCCTACTTCATCCTGAAGCTGGCCGGCCGCTGGCCCGTGAAGATCATCCACACCGACAACGGCTCCAACTTCACCTCCGCCGCCGTGAA
GGCCGCCTGCTGGTGGGCCGGCATCCAGCAGGAGTTCGGCATCCCCTACAACCCCCAGTCCCAGGGCGTGGTGGAGTCCATGAACAAGGAGCTGAAGAAGA
TCATCGGCCAGGTGCGCGACCAGGCCGAGCACCTGAAGACCGCCGTGCAGATGGCCGTGTTCATCCACAACTTCAAGCGCAAGGGCGGCATCGGCGGCTAC
TCCGCCGGCGAGCGCATCATCGACATCATCGCCACCGACATCCAGACCCGCGAGCTGCAGAAGCAGATCACCAAGATCCAGAACTTCCGCGTGTACTACCG
CGACTCCCGCGACCCCGTGTGGAAGGGCCCCGCCAAGCTGCTGTGGAAGGGCGAGGGCGCCGTGGTGATCCAGGACAACTCCGAGATCAAGGTGGTGCCCC
GCCGCAAGGCCAAGATCATCCGCGACTACGGCAAGCAGATGGCCGGCGACGACTGCGTGGCCGGCCGCCAGGACGAGGACTAA

Fig. 115A

72. 2003_CON_F2 pol.PEP

FFRENLAFQQGEARKFSSEQTRANSPASRELRVRRGDNSLPEAGAERQGTGSSLDFPQITLWQRPLVTIKVGGQLREALLDTGADDTVLEDI
NLPGKWKPKMIGGIGGFIKVRQYDQIPIEICGQKAIGTVLVGPTPVNIIGRNMLTQIGCTLNFPISPIETVPVKLKPGMDGPKVKQWPLTEE
KIKALTEICTEMEKEGKISKIGPENPYNTPVFAIKKKDSTKWRKLVDFRELNKRTQDFWEVQLGIPHPAGLKKKKSVTVLDVGDAYFSVPLD
KEFRKYTAFTIPSINNETPGIRYQYNVLPQGWKGSPAIFQSSMTKILEPFRAKNPEIVIYQYMDDLYVGSDLEIGQHRTKIEELREHLLRWG
FTTPDKKHQKEPPFLWMGYELHPDKWTVQAIQLPDKSSWTVNDIQKLVGKLNWASQIYPGIRVKHLCKLLRGAKALTDVVPLTAEAELELAE
NREILKEPVHGVYYDPSKDLIAEIQKQGHDQWTYQIYQEPHKNLKTGKYARRKSAHTNDVKQLTEVVQKIATEGIVIWGKVPKFRLPIQKET
WEIWWTEYWQATWIPEWEFVNTPPLVKLWYQLETEPIVGAETFYVDGAANRETKLGKAGYVTDRGRQKVVPLTETTNQKTELQAIHLALQDS
GSEVNIVTDSQYALGIIQAHPDKSESELVNQIIEQLIQKERVYLSWVPAHKGIGGNEQVDKLVSTGIRKVLFLDGIDKAQEEHEKYHSNWRA
MASDFNLPPVVAKEIVASCDKCQLKGEAMHGQVDCSPGIWQLDCTHLEGKIILVAVHVASGYIEAEVIPAETGQETAYFILKLAGRWPVKII
HTDNGSNFTSTVVKAACWWAGIQQEFGIPYNPQSQGVVESMNKELKKIIGQVRDQAEHLKTAVQMAVFIHNFKRKGGIGGYSAGERIIDIIA
TDIQTKELQKQITKIQNFRVYFRDSRDPVWKGPAKLLWKGEGAVVIQDNNEIKVVPRRKAKIIRDYGKQMAGDDCVAGRQDED$

Fig. 116A

73. 2003_CON_G pol.PEP

FFRENLAFQQGEAREFSSEQARANSPTRRELRVRRGDSPLPEAGAEGKGAISLSFPQITLWQRPLVTVKIGGQLIEALLDTGADDTVLEEIN
LPGKWKPKMIGGIGGFIKVRQYDQILIEISGKKAIGTVLVGPTPINIIGRNMLTQIGCTLNFPISPIETVPVKLKPGMDGPKVKQWPLTEEK
IKALTEICTEMEKEGKISKIGPENPYNTPIFAIKKKDSTKWRKLVDFRELNKRTQDFWEVQLGIPHPAGLKKKKSVTVLDVGDAYFSVPLDE
NFRKYTAFTIPSTNNETPGIRYQYNVLPQGWKGSPAIFQSSMTKILEPFRTKNPEIVIYQYMDDLYVGSDLEIGQHRAKIEELREHLLRWGF
TTPDKKHQKEPPFLWMGYELHPDKWTVQPIQLPDKESWTVNDIQKLVGKLNWASQIYPGIKVKQLCKLLRGAKALTDIVPLTAEAELELAEN
REILKEPVHGVYYDPSKELIAEVQKQGLDQWTYQIYQEPYKNLKTGKYAKRGSAHTNDVKQLTEVVQKIATESIVIWGKTPKFKLPIRKETW
EVWWTEYWQATWIPEWEFVNTPPLVKLWYRLETEPIPGAETYYVDGAANRETKLGKAGYVTDKGKQKIITLTETTNQKAELQAIHLALQDSG
SEVNIVTDSQYALGIIQAQPDRSESELVNQIIEQLIKKEKVYLSWVPAHKGIGGNEQVDKLVSSGIRKVLFLDGIDKAQEEHERYHSNWRAM
ASDFNLPPIVAKEIVASCDKCQLKGEAMHGQVDCSPGIWQLDCTHLEGKIILVAVHVASGYIEAEVIPAETGQETAYFILKLAGRWPVKVIH
TDNGSNFTSAAVKAACWWANITQEFGIPYNPQSQGVVESMNKELKKIIGQVRDQAEHLKTAVQMAVFIHNFKRKGGIGGYSAGERIIDIIAS
DIQTKELQKQITKIQNFRVYYRDSRDPIWKGPAKLLWKGEGAVVIQDNNEIKVVPRRKAKIIRDYGKQMAGDDCVAGRQDED$

Fig. 115B

2003_CON_F2 pol.OPT

TTCTTCCGCGAGAACCTGGCCTTCCAGCAGGGCGAGGCCCGCAAGTTCTCCTCCGAGCAGACCCGCGCCAACTCCCCCGCCTCCCGCGAGCTGCGCGTGCG
CCGCGGCGACAACTCCCTGCCCGAGGCCGGCGCCGAGCGCCAGGGCACCGGCTCCTCCCTGGACTTCCCCCAGATCACCCTGTGGCAGCGCCCCCTGGTGA
CCATCAAGGTGGGCGGCCAGCTGCGCGAGGCCCTGCTGGACACCGGCGCCGACGACACCGTGCTGGAGGACATCAACCTGCCCGGCAAGTGGAAGCCCAAG
ATGATCGGCGGCATCGGCGGCTTCATCAAGGTGCGCCAGTACGACCAGATCCCCATCGAGATCTGCGGCCAGAAGGCCATCGGCACCGTGCTGGTGGGCCC
CACCCCCGTGAACATCATCGGCCGCAACATGCTGACCCAGATCGGCTGCACCCTGAACTTCCCCATCTCCCCCATCGAGACCGTGCCCGTGAAGCTGAAGC
CCGGCATGGACGGCCCCAAGGTGAAGCAGTGGCCCCTGACCGAGGAGAAGATCAAGGCCCTGACCGAGATCTGCACCGAGATGGAGAAGGAGGGCAAGATC
TCCAAGATCGGCCCCGAGAACCCCTACAACACCCCCGTGTTCGCCATCAAGAAGAAGGACTCCACCAAGTGGCGCAAGCTGGTGGACTTCCGCGAGCTGAA
CAAGCGCACCCAGGACTTCTGGGAGGTGCAGCTGGGCATCCCCCACCCCGCCGGCCTGAAGAAGAAGAAGTCCGTGACCGTGCTGGACGTGGGCGACGCCT
ACTTCTCCGTGCCCCTGGACAAGGAGTTCCGCAAGTACACCGCCTTCACCATCCCCTCCATCAACAACGAGACCCCCGGCATCCGCTACCAGTACAACGTG
CTGCCCCAGGGCTGGAAGGGCTCCCCCGCCATCTTCCAGTCCTCCATGACCAAGATCCTGGAGCCCTTCCGCGCCAAGAACCCCGAGATCGTGATCTACCA
GTACATGGACGACCTGTACGTGGGCTCCGACCTGGAGATCGGCCAGCACCGCACCAAGATCGAGGAGCTGCGCGAGCACCTGCTGCGCTGGGGCTTCACCA
CCCCCGACAAGAAGCACCAGAAGGAGCCCCCCTTCCTGTGGATGGGCTACGAGCTGCACCCCGACAAGTGGACCGTGCAGGCCATCCAGCTGCCCGACAAG
TCCTCCTGGACCGTGAACGACATCCAGAAGCTGGTGGGCAAGCTGAACTGGGCCTCCCAGATCTACCCCGGCATCCGCGTGAAGCACCTGTGCAAGCTGCT
GCGCGGCGCCAAGGCCCTGACCGACGTGGTGCCCCTGACCGCCGAGGCCGAGCTGGAGCTGGCCGAGAACCGCGAGATCCTGAAGGAGCCCGTGCACGGCG
TGTACTACGACCCCTCCAAGGACCTGATCGCCGAGATCCAGAAGCAGGGCCACGACCAGTGGACCTACCAGATCTACCAGGAGCCCCACAAGAACCTGAAG
ACCGGCAAGTACGCCCGCCGCAAGTCCGCCCACACCAACGACGTGAAGCAGCTGACCGAGGTGGTGCAGAAGATCGCCACCGAGGGCATCGTGATCTGGGG
CAAGGTGCCCAAGTTCCGCCTGCCCATCCAGAAGGAGACCTGGGAGATCTGGTGGACCGAGTACTGGCAGGCCACCTGGATCCCCGAGTGGGAGTTCGTGA
ACACCCCCCCCCTGGTGAAGCTGTGGTACCAGCTGGAGACCGAGCCCATCGTGGGCGCCGAGACCTTCTACGTGGACGGCGCCGCCAACCGCGAGACCAAG
CTGGGCAAGGCCGGCTACGTGACCGACCGCGGCCGCCAGAAGGTGGTGCCCCTGACCGAGACCACCAACCAGAAGACCGAGCTGCAGGCCATCCACCTGGC
CCTGCAGGACTCCGGCTCCGAGGTGAACATCGTGACCGACTCCCAGTACGCCCTGGGCATCATCCAGGCCCACCCCGACAAGTCCGAGTCCGAGCTGGTGA
ACCAGATCATCGAGCAGCTGATCCAGAAGGAGCGCGTGTACCTGTCCTGGGTGCCCGCCCACAAGGGCATCGGCGGCAACGAGCAGGTGGACAAGCTGGTG
TCCACCGGCATCCGCAAGGTGCTGTTCCTGGACGGCATCGACAAGGCCCAGGAGGAGCACGAGAAGTACCACTCCAACTGGCGCGCCATGGCCTCCGACTT
CAACCTGCCCCCCGTGGTGGCCAAGGAGATCGTGGCCTCCTGCGACAAGTGCCAGCTGAAGGGCGAGGCCATGCACGGCCAGGTGGACTGCTCCCCCGGCA
TCTGGCAGCTGGACTGCACCCACCTGGAGGGCAAGATCATCCTGGTGGCCGTGCACGTGGCCTCCGGCTACATCGAGGCCGAGGTGATCCCCGCCGAGACC
GGCCAGGAGACCGCCTACTTCATCCTGAAGCTGGCCGGCCGCTGGCCCGTGAAGATCATCCACACCGACAACGGCTCCAACTTCACCTCCACCGTGGTGAA
GGCCGCCTGCTGGTGGGCCGGCATCCAGCAGGAGTTCGGCATCCCCTACAACCCCCAGTCCCAGGGCGTGGTGGAGTCCATGAACAAGGAGCTGAAGAAGA
TCATCGGCCAGGTGCGCGACCAGGCCGAGCACCTGAAGACCGCCGTGCAGATGGCCGTGTTCATCCACAACTTCAAGCGCAAGGGCGGCATCGGCGGCTAC
TCCGCCGGCGAGCGCATCATCGACATCATCGCCACCGACATCCAGACCAAGGAGCTGCAGAAGCAGATCACCAAGATCCAGAACTTCCGCGTGTACTTCCG
CGACTCCCGCGACCCCGTGTGGAAGGGCCCCGCCAAGCTGCTGTGGAAGGGCGAGGGCGCCGTGGTGATCCAGGACAACAACGAGATCAAGGTGGTGCCCC
GCCGCAAGGCCAAGATCATCCGCGACTACGGCAAGCAGATGGCCGGCGACGACTGCGTGGCCGGCCGCCAGGACGAGGACTAA

Fig. 116B

2003_CON_G pol.OPT

TTCTTCCGCGAGAACCTGGCCTTCCAGCAGGGCGAGGCCCGCGAGTTCTCCTCCGAGCAGGCCCGCGCCAACTCCCCCACCCGCCGCGAGCTGCGCGTGCG
CCGCGGCGACTCCCCCCTGCCCGAGGCCGGCGCCGAGGGCAAGGGCGCCATCTCCCTGTCCTTCCCCCAGATCACCCTGTGGCAGCGCCCCCTGGTGACCG
TGAAGATCGGCGGCCAGCTGATCGAGGCCCTGCTGGACACCGGCGCCGACGACACCGTGCTGGAGGAGATCAACCTGCCCGGCAAGTGGAAGCCCAAGATG
ATCGGCGGCATCGGCGGCTTCATCAAGGTGCGCCAGTACGACCAGATCCTGATCGAGATCTCCGGCAAGAAGGCCATCGGCACCGTGCTGGTGGGCCCCAC
CCCCATCAACATCATCGGCCGCAACATGCTGACCCAGATCGGCTGCACCCTGAACTTCCCCATCTCCCCCATCGAGACCGTGCCCGTGAAGCTGAAGCCCG
GCATGGACGGCCCCAAGGTGAAGCAGTGGCCCCTGACCGAGGAGAAGATCAAGGCCCTGACCGAGATCTGCACCGAGATGGAGAAGGAGGGCAAGATCTCC
AAGATCGGCCCCGAGAACCCCTACAACACCCCCATCTTCGCCATCAAGAAGAAGGACTCCACCAAGTGGCGCAAGCTGGTGGACTTCCGCGAGCTGAACAA
GCGCACCCAGGACTTCTGGGAGGTGCAGCTGGGCATCCCCCACCCCGCCGGCCTGAAGAAGAAGAAGTCCGTGACCGTGCTGGACGTGGGCGACGCCTACT
TCTCCGTGCCCCTGGACGAGAACTTCCGCAAGTACACCGCCTTCACCATCCCCTCCACCAACAACGAGACCCCCGGCATCCGCTACCAGTACAACGTGCTG
CCCCAGGGCTGGAAGGGCTCCCCCGCCATCTTCCAGTCCTCCATGACCAAGATCCTGGAGCCCTTCCGCACCAAGAACCCCGAGATCGTGATCTACCAGTA
CATGGACGACCTGTACGTGGGCTCCGACCTGGAGATCGGCCAGCACCGCGCCAAGATCGAGGAGCTGCGCGAGCACCTGCTGCGCTGGGGCTTCACCACCC
CCGACAAGAAGCACCAGAAGGAGCCCCCCTTCCTGTGGATGGGCTACGAGCTGCACCCCGACAAGTGGACCGTGCAGCCCATCCAGCTGCCCGACAAGGAG
TCCTGGACCGTGAACGACATCCAGAAGCTGGTGGGCAAGCTGAACTGGGCCTCCCAGATCTACCCCGGCATCAAGGTGAAGCAGCTGTGCAAGCTGCTGCG
CGGCGCCAAGGCCCTGACCGACATCGTGCCCCTGACCGCCGAGGCCGAGCTGGAGCTGGCCGAGAACCGCGAGATCCTGAAGGAGCCCGTGCACGGCGTGT
ACTACGACCCCTCCAAGGAGCTGATCGCCGAGGTGCAGAAGCAGGGCCTGGACCAGTGGACCTACCAGATCTACCAGGAGCCCTACAAGAACCTGAAGACC
GGCAAGTACGCCAAGCGCGGCTCCGCCCACACCAACGACGTGAAGCAGCTGACCGAGGTGGTGCAGAAGATCGCCACCGAGTCCATCGTGATCTGGGGCAA
GACCCCCAAGTTCAAGCTGCCCATCCGCAAGGAGACCTGGGAGGTGTGGTGGACCGAGTACTGGCAGGCCACCTGGATCCCCGAGTGGGAGTTCGTGAACA
CCCCCCCCCTGGTGAAGCTGTGGTACCGCCTGGAGACCGAGCCCATCCCCGGCGCCGAGACCTACTACGTGGACGGCGCCGCCAACCGCGAGACCAAGCTG
GGCAAGGCCGGCTACGTGACCGACAAGGGCAAGCAGAAGATCATCACCCTGACCGAGACCACCAACCAGAAGGCCGAGCTGCAGGCCATCCACCTGGCCCT
GCAGGACTCCGGCTCCGAGGTGAACATCGTGACCGACTCCCAGTACGCCCTGGGCATCATCCAGGCCCAGCCCGACCGCTCCGAGTCCGAGCTGGTGAACC
AGATCATCGAGCAGCTGATCAAGAAGGAGAAGGTGTACCTGTCCTGGGTGCCCGCCCACAAGGGCATCGGCGGCAACGAGCAGGTGGACAAGCTGGTGTCC
TCCGGCATCCGCAAGGTGCTGTTCCTGGACGGCATCGACAAGGCCCAGGAGGAGCACGAGCGCTACCACTCCAACTGGCGCGCCATGGCCTCCGACTTCAA
CCTGCCCCCCATCGTGGCCAAGGAGATCGTGGCCTCCTGCGACAAGTGCCAGCTGAAGGGCGAGGCCATGCACGGCCAGGTGGACTGCTCCCCCGGCATCT
GGCAGCTGGACTGCACCCACCTGGAGGGCAAGATCATCCTGGTGGCCGTGCACGTGGCCTCCGGCTACATCGAGGCCGAGGTGATCCCCGCCGAGACCGGC
CAGGAGACCGCCTACTTCATCCTGAAGCTGGCCGGCCGCTGGCCCGTGAAGGTGATCCACACCGACAACGGCTCCAACTTCACCTCCGCCGCCGTGAAGGC
CGCCTGCTGGTGGGCCAACATCACCCAGGAGTTCGGCATCCCCTACAACCCCCAGTCCCAGGGCGTGGTGGAGTCCATGAACAAGGAGCTGAAGAAGATCA
TCGGCCAGGTGCGCGACCAGGCCGAGCACCTGAAGACCGCCGTGCAGATGGCCGTGTTCATCCACAACTTCAAGCGCAAGGGCGGCATCGGCGGCTACTCC
GCCGGCGAGCGCATCATCGACATCATCGCCTCCGACATCCAGACCAAGGAGCTGCAGAAGCAGATCACCAAGATCCAGAACTTCCGCGTGTACTACCGCGA
CTCCCGCGACCCCATCTGGAAGGGCCCCGCCAAGCTGCTGTGGAAGGGCGAGGGCGCCGTGGTGATCCAGGACAACAACGAGATCAAGGTGGTGCCCCGCC
GCAAGGCCAAGATCATCCGCGACTACGGCAAGCAGATGGCCGGCGACGACTGCGTGGCCGGCCGCCAGGACGAGGACTAA

Fig. 117A

74. 2003_CON_H pol.PEP

FFRENLAFQQREARKFSPEQARANSPTSRELRVRRGDDPLSEAGAEGQGTSLSFPQITLWQRPLVTVKIEGQLREALLDTGADDTVLEEINL
PGKWKPKMIGGIGGFIKVRQYEQVAIEICGKKAIGTVLVGPTPVNIIGRNILTQIGCTLNFPISPIETVPVKLKPGMDGPKVKQWPLTEEKI
KALTEICIEMEKEGKISKIGPENPYNTPIFAIKKKDSTKWRKLVDFRELNKRTQDFWEVQLGIPHPAGLKKKKSVSVLDVGDAYFSVPLDKD
FRKYTAFTIPSINNETPGIRYQYNVLPQGWKGSPAIFQSSMTKILEPFRKQNPEMIIYQYMDDLYVGSDLEIGQHRAKIEELRAHLLRWGFT
TPDKKHQKEPPFLWMGYELHPDKWTVQPVKLPEKDSWTVNDIQKLVGKLNWASQIYPGIKVKQLCKLLRGAKALTDIVPLTKEAELELAENR
EILREPVHGVYYDPSKDLIAEIQKQGPDQWTYQIYQEPFKNLKTGKYAKMRTAHTNDVKQLTEAVQKIATESIVIWGKIPKFRLPIQKETWE
TWWTEHWQATWIPEWEFVNTPHLVKLWYQLETEPIAGAETYYVDGAANRETKIGKAGYVTDRGKQKVVSLTETTNQKTELQAIYLALQDSGL
EVNIVTDSQYALGIIQAQPDKSESELVNQIIEELIKKEKVYLSWVPAHKGIGGNEQVDKLVSSGIRKVLFLDGIDKAQEEHERYHNNWRAMA
SDFNLPPIVAKEIVASCDKCQLKGEAMHGQVDCSPGIWQLDCTHLEGKVILVAVHVASGYIEAEVIPAETGQETAYFILKLAGRWPVKMIHT
DNGSNFTSAAVKAACWWADIQQEFGIPYNPQSQGVVESMNKELKKIIGQVRDQAEHLRTAVQMAVFIHNFKRKGGIGGYSAGERIIDIIATD
IQTKELQKQISKIQKFRVYYRDSRDPIWKGPAKLLWKGEGAVVIQDNSEIKVVPRRKAKIIRDYGKQMAGDDCVAGRQDED$

Fig. 118A

75. 2003_CON_01_AE pol.PEP

FFRENLAFQQGKAGEFSSEQTRANSPTSRKLGDGGRDNLLTEAGAERQGTSSSFSFPQITLWQRPLVTVKIGGQLKEALLDTGADDTVLEDI
NLPGKWKPKMIGGIGGFIKVRQYDQILIEICGKKAIGTVLVGPTPVNIIGRNMLTQIGCTLNFPISPIDTVPVTLKPGMDGPKVKQWPLTEE
KIKALTEICKEMEEEGKISKIGPENPYNTPVFAIKKKDSTKWRKLVDFRELNKRTQDFWEVQLGIPHPAGLKKKKSVTVLDVGDAYFSVPLD
ESFRKYTAFTIPSINNETPGIRYQYNVLPQGWKGSPAIFQSSMTKILEPFRIKNPEMVIYQYMDDLYVGSDLEIGQHRTKIEELRAHLLSWG
FTTPDKKHQKEPPFLWMGYELHPDRWTVQPIELPEKDSWTVNDIQKLVGKLNWASQIYAGIKVKQLCKLLRGAKALTDIVPLTEEAELELAE
NREILKTPVHGVYYDPSKDLVAEVQKQGQDQWTYQIYQEPFKNLKTGKYARKRSAHTNDVRQLTEVVQKIATESIVIWGKTPKFRLPIQRET
WETWWMEYWQATWIPEWEFVNTPPLVKLWYQLEKDPIVGAETFYVDGAASRETKLGKAGYVTDRGRQKVVSLTETTNQKTELHAIHLALQDS
GSEVNIVTDSQYALGIIQAQPDRSESEVVNQIIEELIKKEKVYLSWVPAHKGIGGNEQVDKLVSSGIRKVLFLDGIDKAQEEHERYHSNWRT
MASDFNLPPIVAKEIVANCDKCQLKGEAMHGQVDCSPGIWQLDCTHLEGKVILVAVHVASGYIEAEVIPAETGQETAYFLLKLAGRWPVKVI
HTDNGSNFTSAAVKAACWWANVRQEFGIPYNPQSQGVVESMNKELKKIIGQVREQAEHLKTAVQMAVFIHNFKRKGGIGGYSAGERIIDIIA
TDIQTKELQKQITKIQNFRVYYRDSRDPIWKGPAKLLWKGEGAVVIQDNSDIKVVPRRKAKIIRDYGKQMAGDDCVAGRQDED$

Fig. 117B

2003_CON_H pol.OPT

TTCTTCCGCGAGAACCTGGCCTTCCAGCAGCGCGAGGCCCGCAAGTTCTCCCCCGAGCAGGCCCGCGCCAACTCCCCCACCTCCCGCGAGCTGCGCGTGCG
CCGCGGCGACGACCCCCTGTCCGAGGCCGGCGCCGAGGGCCAGGGCACCTCCCTGTCCTTCCCCCAGATCACCCTGTGGCAGCGCCCCCTGGTGACCGTGA
AGATCGAGGGCCAGCTGCGCGAGGCCCTGCTGGACACCGGCGCCGACGACACCGTGCTGGAGGAGATCAACCTGCCCGGCAAGTGGAAGCCCAAGATGATC
GGCGGCATCGGCGGCTTCATCAAGGTGCGCCAGTACGAGCAGGTGGCCATCGAGATCTGCGGCAAGAAGGCCATCGGCACCGTGCTGGTGGGCCCCACCCC
CGTGAACATCATCGGCCGCAACATCCTGACCCAGATCGGCTGCACCCTGAACTTCCCCATCTCCCCCATCGAGACCGTGCCCGTGAAGCTGAAGCCCGGCA
TGGACGGCCCCAAGGTGAAGCAGTGGCCCCTGACCGAGGAGAAGATCAAGGCCCTGACCGAGATCTGCATCGAGATGGAGAAGGAGGGCAAGATCTCCAAG
ATCGGCCCCGAGAACCCCTACAACACCCCCATCTTCGCCATCAAGAAGAAGGACTCCACCAAGTGGCGCAAGCTGGTGGACTTCCGCGAGCTGAACAAGCG
CACCCAGGACTTCTGGGAGGTGCAGCTGGGCATCCCCCACCCCGCCGGCCTGAAGAAGAAGAAGTCCGTGTCCGTGCTGGACGTGGGCGACGCCTACTTCT
CCGTGCCCCTGGACAAGGACTTCCGCAAGTACACCGCCTTCACCATCCCCTCCATCAACAACGAGACCCCCGGCATCCGCTACCAGTACAACGTGCTGCCC
CAGGGCTGGAAGGGCTCCCCCGCCATCTTCCAGTCCTCCATGACCAAGATCCTGGAGCCCTTCCGCAAGCAGAACCCCGAGATGATCATCTACCAGTACAT
GGACGACCTGTACGTGGGCTCCGACCTGGAGATCGGCCAGCACCGCGCCAAGATCGAGGAGCTGCGCGCCCACCTGCTGCGCTGGGGCTTCACCACCCCCG
ACAAGAAGCACCAGAAGGAGCCCCCCTTCCTGTGGATGGGCTACGAGCTGCACCCCGACAAGTGGACCGTGCAGCCCGTGAAGCTGCCCGAGAAGGACTCC
TGGACCGTGAACGACATCCAGAAGCTGGTGGGCAAGCTGAACTGGGCCTCCCAGATCTACCCCGGCATCAAGGTGAAGCAGCTGTGCAAGCTGCTGCGCGG
CGCCAAGGCCCTGACCGACATCGTGCCCCTGACCAAGGAGGCCGAGCTGGAGCTGGCCGAGAACCGCGAGATCCTGCGCGAGCCCGTGCACGGCGTGTACT
ACGACCCCTCCAAGGACCTGATCGCCGAGATCCAGAAGCAGGGCCCCGACCAGTGGACCTACCAGATCTACCAGGAGCCCTTCAAGAACCTGAAGACCGGC
AAGTACGCCAAGATGCGCACCGCCCACACCAACGACGTGAAGCAGCTGACCGAGGCCGTGCAGAAGATCGCCACCGAGTCCATCGTGATCTGGGGCAAGAT
CCCCAAGTTCCGCCTGCCCATCCAGAAGGAGACCTGGGAGACCTGGTGGACCGAGCACTGGCAGGCCACCTGGATCCCCGAGTGGGAGTTCGTGAACACCC
CCCACCTGGTGAAGCTGTGGTACCAGCTGGAGACCGAGCCCATCGCCGGCGCCGAGACCTACTACGTGGACGGCGCCGCCAACCGCGAGACCAAGATCGGC
AAGGCCGGCTACGTGACCGACCGCGGCAAGCAGAAGGTGGTGTCCCTGACCGAGACCACCAACCAGAAGACCGAGCTGCAGGCCATCTACCTGGCCCTGCA
GGACTCCGGCCTGGAGGTGAACATCGTGACCGACTCCCAGTACGCCCTGGGCATCATCCAGGCCCAGCCCGACAAGTCCGAGTCCGAGCTGGTGAACCAGA
TCATCGAGGAGCTGATCAAGAAGGAGAAGGTGTACCTGTCCTGGGTGCCCGCCCACAAGGGCATCGGCGGCAACGAGCAGGTGGACAAGCTGGTGTCCTCC
GGCATCCGCAAGGTGCTGTTCCTGGACGGCATCGACAAGGCCCAGGAGGAGCACGAGCGCTACCACAACAACTGGCGCGCCATGGCCTCCGACTTCAACCT
GCCCCCCATCGTGGCCAAGGAGATCGTGGCCTCCTGCGACAAGTGCCAGCTGAAGGGCGAGGCCATGCACGGCCAGGTGGACTGCTCCCCCGGCATCTGGC
AGCTGGACTGCACCCACCTGGAGGGCAAGGTGATCCTGGTGGCCGTGCACGTGGCCTCCGGCTACATCGAGGCCGAGGTGATCCCCGCCGAGACCGGCCAG
GAGACCGCCTACTTCATCCTGAAGCTGGCCGGCCGCTGGCCCGTGAAGATGATCCACACCGACAACGGCTCCAACTTCACCTCCGCCGCCGTGAAGGCCGC
CTGCTGGTGGGCCGACATCCAGCAGGAGTTCGGCATCCCCTACAACCCCCAGTCCCAGGGCGTGGTGGAGTCCATGAACAAGGAGCTGAAGAAGATCATCG
GCCAGGTGCGCGACCAGGCCGAGCACCTGCGCACCGCCGTGCAGATGGCCGTGTTCATCCACAACTTCAAGCGCAAGGGCGGCATCGGCGGCTACTCCGCC
GGCGAGCGCATCATCGACATCATCGCCACCGACATCCAGACCAAGGAGCTGCAGAAGCAGATCTCCAAGATCCAGAAGTTCCGCGTGTACTACCGCGACTC
CCGCGACCCCATCTGGAAGGGCCCCGCCAAGCTGCTGTGGAAGGGCGAGGGCGCCGTGGTGATCCAGGACAACTCCGAGATCAAGGTGGTGCCCCGCCGCA
AGGCCAAGATCATCCGCGACTACGGCAAGCAGATGGCCGGCGACGACTGCGTGGCCGGCCGCCAGGACGAGGACTAA

Fig. 118B

2003_CON_01_AE pol.OPT

TTCTTCCGCGAGAACCTGGCCTTCCAGCAGGGCAAGGCCGGCGAGTTCTCCTCCGAGCAGACCCGCGCCAACTCCCCCACCTCCCGCAAGCTGGGCGACGG
CGGCCGCGACAACCTGCTGACCGAGGCCGGCGCCGAGCGCCAGGGCACCTCCTCCTCCTTCTCCTTCCCCCAGATCACCCTGTGGCAGCGCCCCCTGGTGA
CCGTGAAGATCGGCGGCCAGCTGAAGGAGGCCCTGCTGGACACCGGCGCCGACGACACCGTGCTGGAGGACATCAACCTGCCCGGCAAGTGGAAGCCCAAG
ATGATCGGCGGCATCGGCGGCTTCATCAAGGTGCGCCAGTACGACCAGATCCTGATCGAGATCTGCGGCAAGAAGGCCATCGGCACCGTGCTGGTGGGCCC
CACCCCCGTGAACATCATCGGCCGCAACATGCTGACCCAGATCGGCTGCACCCTGAACTTCCCCATCTCCCCCATCGACACCGTGCCCGTGACCCTGAAGC
CCGGCATGGACGGCCCCAAGGTGAAGCAGTGGCCCCTGACCGAGGAGAAGATCAAGGCCCTGACCGAGATCTGCAAGGAGATGGAGGAGGAGGGCAAGATC
TCCAAGATCGGCCCCGAGAACCCCTACAACACCCCCGTGTTCGCCATCAAGAAGAAGGACTCCACCAAGTGGCGCAAGCTGGTGGACTTCCGCGAGCTGAA
CAAGCGCACCCAGGACTTCTGGGAGGTGCAGCTGGGCATCCCCCACCCCGCCGGCCTGAAGAAGAAGAAGTCCGTGACCGTGCTGGACGTGGGCGACGCCT
ACTTCTCCGTGCCCCTGGACGAGTCCTTCCGCAAGTACACCGCCTTCACCATCCCCTCCATCAACAACGAGACCCCCGGCATCCGCTACCAGTACAACGTG
CTGCCCCAGGGCTGGAAGGGCTCCCCCGCCATCTTCCAGTCCTCCATGACCAAGATCCTGGAGCCCTTCCGCATCAAGAACCCCGAGATGGTGATCTACCA
GTACATGGACGACCTGTACGTGGGCTCCGACCTGGAGATCGGCCAGCACCGCACCAAGATCGAGGAGCTGCGCGCCCACCTGCTGTCCTGGGGCTTCACCA
CCCCCGACAAGAAGCACCAGAAGGAGCCCCCCTTCCTGTGGATGGGCTACGAGCTGCACCCCGACCGCTGGACCGTGCAGCCCATCGAGCTGCCCGAGAAG
GACTCCTGGACCGTGAACGACATCCAGAAGCTGGTGGGCAAGCTGAACTGGGCCTCCCAGATCTACGCCGGCATCAAGGTGAAGCAGCTGTGCAAGCTGCT
GCGCGGCGCCAAGGCCCTGACCGACATCGTGCCCCTGACCGAGGAGGCCGAGCTGGAGCTGGCCGAGAACCGCGAGATCCTGAAGACCCCCGTGCACGGCG
TGTACTACGACCCCTCCAAGGACCTGGTGGCCGAGGTGCAGAAGCAGGGCCAGGACCAGTGGACCTACCAGATCTACCAGGAGCCCTTCAAGAACCTGAAG
ACCGGCAAGTACGCCCGCAAGCGCTCCGCCCACACCAACGACGTGCGCCAGCTGACCGAGGTGGTGCAGAAGATCGCCACCGAGTCCATCGTGATCTGGGG
CAAGACCCCCAAGTTCCGCCTGCCCATCCAGCGCGAGACCTGGGAGACCTGGTGGATGGAGTACTGGCAGGCCACCTGGATCCCCGAGTGGGAGTTCGTGA
ACACCCCCCCCCTGGTGAAGCTGTGGTACCAGCTGGAGAAGGACCCCATCGTGGGCGCCGAGACCTTCTACGTGGACGGCGCCGCCTCCCGCGAGACCAAG
CTGGGCAAGGCCGGCTACGTGACCGACCGCGGCCGCCAGAAGGTGGTGTCCCTGACCGAGACCACCAACCAGAAGACCGAGCTGCACGCCATCCACCTGGC
CCTGCAGGACTCCGGCTCCGAGGTGAACATCGTGACCGACTCCCAGTACGCCCTGGGCATCATCCAGGCCCAGCCCGACCGCTCCGAGTCCGAGGTGGTGA
ACCAGATCATCGAGGAGCTGATCAAGAAGGAGAAGGTGTACCTGTCCTGGGTGCCCGCCCACAAGGGCATCGGCGGCAACGAGCAGGTGGACAAGCTGGTG
TCCTCCGGCATCCGCAAGGTGCTGTTCCTGGACGGCATCGACAAGGCCCAGGAGGAGCACGAGCGCTACCACTCCAACTGGCGCACCATGGCCTCCGACTT
CAACCTGCCCCCCATCGTGGCCAAGGAGATCGTGGCCAACTGCGACAAGTGCCAGCTGAAGGGCGAGGCCATGCACGGCCAGGTGGACTGCTCCCCCGGCA
TCTGGCAGCTGGACTGCACCCACCTGGAGGGCAAGGTGATCCTGGTGGCCGTGCACGTGGCCTCCGGCTACATCGAGGCCGAGGTGATCCCCGCCGAGACC
GGCCAGGAGACCGCCTACTTCCTGCTGAAGCTGGCCGGCCGCTGGCCCGTGAAGGTGATCCACACCGACAACGGCTCCAACTTCACCTCCGCCGCCGTGAA
GGCCGCCTGCTGGTGGGCCAACGTGCGCCAGGAGTTCGGCATCCCCTACAACCCCCAGTCCCAGGGCGTGGTGGAGTCCATGAACAAGGAGCTGAAGAAGA
TCATCGGCCAGGTGCGCGAGCAGGCCGAGCACCTGAAGACCGCCGTGCAGATGGCCGTGTTCATCCACAACTTCAAGCGCAAGGGCGGCATCGGCGGCTAC
TCCGCCGGCGAGCGCATCATCGACATCATCGCCACCGACATCCAGACCAAGGAGCTGCAGAAGCAGATCACCAAGATCCAGAACTTCCGCGTGTACTACCG
CGACTCCCGCGACCCCATCTGGAAGGGCCCCGCCAAGCTGCTGTGGAAGGGCGAGGGCGCCGTGGTGATCCAGGACAACTCCGACATCAAGGTGGTGCCCC
GCCGCAAGGCCAAGATCATCCGCGACTACGGCAAGCAGATGGCCGGCGACGACTGCGTGGCCGGCCGCCAGGACGAGGACTAA

*Fig. 119A*

76. 2003_CON_02_AG pol.PEP

FFRENLAFQQGEARKFSSEQTGTNSPTSRELWDGGRDNLLSEAGTEGQGTISSFNFPQITLWQRPLVTVRIGGQLIEALLDTGADDTVLEEI
NLPGKWKPKMIGGIGGFIKVRQYDQILIEICGKKAIGTVLVGPTPVNIIGRNMLTQIGCTLNFPISPIETVPVKLKPGMDGPKVKQWPLTEE
KIKALTDICTEMEKEGKISKIGPENPYNTPVFAIKKKDSTKWRKLVDFRELNKRTQDFWEVQLGIPHPAGLKKKKSVTVLDVGDAYFSVPLD
KDFRKYTAFTIPSVNNETPGIRYQYNVLPQGWKGSPAIFQASMTKILEPFRTKNPEIVIYQYMDDLYVGSDLEIGQHRAKIEELREHLLRWG
FTTPDKKHQKEPPFLWMGYELHPDKWTVQPIQLPEKDSWTVNDIQKLVGKLNWASQIYAGIKVKQLCKLLRGAKALTDIVTLTEEAELELAE
NREILKEPVHGVYYDPTKDLIAEIQKQGQDQWTYQIYQEPFKNLKTGKYAKMRSAHTNDVKQLTEVVQKVATESIVIWGKTPKFRLPIQRET
WEAWWMEYWQATWIPEWEFVNTPPLVKLWYQLEKDPIVGAETFYVDGAANRETKLGKAGYVTDRGRQKVVSLTETTNQKTELHAIHLALQDS
GSEVNIVTDSQYALGIIQAQPDRSESELVNQIIEKLIEKDKVYLSWVPAHKGIGGNEQVDKLVSNGIRKVLFLDGIDKAQEEHERYHSNWRA
MASDFNLPPIVAKEIVASCDKCQLKGEAMHGQVDCSPGIWQLDCTHLEGKIILVAVHVASGYIEAEVIPAETGQETAYFILKLAGRWPVKVI
HTDNGSNFTSAAVKAACWWANVTQEFGIPYNPQSQGVVESMNKELKKIIGQVRDQAEHLKTAVQMAVFIHNFKRKGGIGGYSAGERIIDIIA
SDIQTKELQKQITKIQNFRVYYRDSRDPIWKGPAKLLWKGEGAVVIQDNSDIKVVPRRKAKIIRDYGKQMAGDDCVAGRQDED$

*Fig. 120A*

77. 2003_CON_03_AB pol.PEP

FFRENLAFQQREARKFSSEQTRAISPTSRKLWDGGRDNPLPETGTERQGTASSFNFPQITLWQRPLVTVRIGGQLKEALLDTGADDTVLEDI
NLPGKWKPKMIGGIGGFIKVRQYDQILIEICGKKAIGTVLVGPTPVNIIGRNMLTQLGCTLNFPISPIETVPVTLKPGMDGPKVKQWPLTEE
KIKALTDICKEMEKEGKISKIGPENPYNTPVFAIKKKDSTKWRKLVDFRELNKRTQDFWEVQLGIPHPAGLKKKKSVTVLDVGDAYFSVPLD
QDFRKYTAFTIPSTNNETPGIRYQYNVLPQGWKGSPAIFQSSMTKILEPFRKQNPEIVIYQYMDDLYVGSDLEIGQHRTKIEELREHLLRWG
FTTPDKKHQKEPPFLWMGYELHPDKWTVQPIVLPEKDSWTVNDIQKLVGKLNWASQIYAGIKVRQLCKLLRGAKALTEVIPLTAEAELELAE
NREILKEPVHGVYYDPSKDLVAEIQKQGQGQWTYQIYQEPFKNLKTGKYARLRGAHTNDVKQLTEAVQKIATESIVIWGKTPKFKLPIQKET
WETWWTEYWQATWIPEWEFVNTPPLVKLWYQLEKEPIVGAETFYVDGAANRETKSGKAGYVTDRGRQKVVSLTDTTNQKTELQAIHLALQDS
GLEVNIVTDSQYALGIIQAQPDKSESELVSQIIEQLIKKEKVYLAWVPAHKGIGGNEQVDKLVSAGIRKVLFLDGIDKAQEAHEKYHSNWRA
MASDFNLPPVVAKEIVASCDKCQLKGEAMHGQVDCSPGIWQLDCTHLEGKIILVAVHVASGYIEAEVIPAETGQETAYFVLKLAGRWPVKII
HTDNGSNFISTAVKAACWWAGIKQEFGIPYNPQSQGVVESMNKQLKQIIGQVRDQAEHLKTAVQMAVFIHNFKRKGGIGGYSAGERIIDIIA
TDIQTKELQKQIIKIQNFRVYYRDSRDPIWKGPAKLLWKGEGAVVIQDNNDIKVVPRRKAKIIRDYGKQMAGDDCVASRQDED$

Fig. 119B

2003_CON_02_AG pol.OPT

TTCTTCCGCGAGAACCTGGCCTTCCAGCAGGGCGAGGCCCGCAAGTTCTCCTCCGAGCAGACCGGCACCAACTCCCCCACCTCCCGCGAGCTGTGGGACGG
CGGCCGCGACAACCTGCTGTCCGAGGCCGGCACCGAGGGCCAGGGCACCATCTCCTCCTTCAACTTCCCCCAGATCACCCTGTGGCAGCGCCCCCTGGTGA
CCGTGCGCATCGGCGGCCAGCTGATCGAGGCCCTGCTGGACACCGGCGCCGACGACACCGTGCTGGAGGAGATCAACCTGCCCGGCAAGTGGAAGCCCAAG
ATGATCGGCGGCATCGGCGGCTTCATCAAGGTGCGCCAGTACGACCAGATCCTGATCGAGATCTGCGGCAAGAAGGCCATCGGCACCGTGCTGGTGGGCCC
CACCCCCGTGAACATCATCGGCCGCAACATGCTGACCCAGATCGGCTGCACCCTGAACTTCCCCATCTCCCCCATCGAGACCGTGCCCGTGAAGCTGAAGC
CCGGCATGGACGGCCCCAAGGTGAAGCAGTGGCCCCTGACCGAGGAGAAGATCAAGGCCCTGACCGACATCTGCACCGAGATGGAGAAGGAGGGCAAGATC
TCCAAGATCGGCCCCGAGAACCCCTACAACACCCCCGTGTTCGCCATCAAGAAGAAGGACTCCACCAAGTGGCGCAAGCTGGTGGACTTCCGCGAGCTGAA
CAAGCGCACCCAGGACTTCTGGGAGGTGCAGCTGGGCATCCCCCACCCCGCCGGCCTGAAGAAGAAGAAGTCCGTGACCGTGCTGGACGTGGGCGACGCCT
ACTTCTCCGTGCCCCTGGACAAGGACTTCCGCAAGTACACCGCCTTCACCATCCCCTCCGTGAACAACGAGACCCCCGGCATCCGCTACCAGTACAACGTG
CTGCCCCAGGGCTGGAAGGGCTCCCCCGCCATCTTCCAGGCCTCCATGACCAAGATCCTGGAGCCCTTCCGCACCAAGAACCCCGAGATCGTGATCTACCA
GTACATGGACGACCTGTACGTGGGCTCCGACCTGGAGATCGGCCAGCACCGCGCCAAGATCGAGGAGCTGCGCGAGCACCTGCTGCGCTGGGGCTTCACCA
CCCCCGACAAGAAGCACCAGAAGGAGCCCCCCTTCCTGTGGATGGGCTACGAGCTGCACCCCGACAAGTGGACCGTGCAGCCCATCCAGCTGCCCGAGAAG
GACTCCTGGACCGTGAACGACATCCAGAAGCTGGTGGGCAAGCTGAACTGGGCCTCCCAGATCTACGCCGGCATCAAGGTGAAGCAGCTGTGCAAGCTGCT
GCGCGGCGCCAAGGCCCTGACCGACATCGTGACCCTGACCGAGGAGGCCGAGCTGGAGCTGGCCGAGAACCGCGAGATCCTGAAGGAGCCCGTGCACGGCG
TGTACTACGACCCCACCAAGGACCTGATCGCCGAGATCCAGAAGCAGGGCCAGGACCAGTGGACCTACCAGATCTACCAGGAGCCCTTCAAGAACCTGAAG
ACCGGCAAGTACGCCAAGATGCGCTCCGCCCACACCAACGACGTGAAGCAGCTGACCGAGGTGGTGCAGAAGGTGGCCACCGAGTCCATCGTGATCTGGGG
CAAGACCCCCAAGTTCCGCCTGCCCATCCAGCGCGAGACCTGGGAGGCCTGGTGGATGGAGTACTGGCAGGCCACCTGGATCCCCGAGTGGGAGTTCGTGA
ACACCCCCCCCCTGGTGAAGCTGTGGTACCAGCTGGAGAAGGACCCCATCGTGGGCGCCGAGACCTTCTACGTGGACGGCGCCGCCAACCGCGAGACCAAG
CTGGGCAAGGCCGGCTACGTGACCGACCGCGGCCGCCAGAAGGTGGTGTCCCTGACCGAGACCACCAACCAGAAGACCGAGCTGCACGCCATCCACCTGGC
CCTGCAGGACTCCGGCTCCGAGGTGAACATCGTGACCGACTCCCAGTACGCCCTGGGCATCATCCAGGCCCAGCCCGACCGCTCCGAGTCCGAGCTGGTGA
ACCAGATCATCGAGAAGCTGATCGAGAAGGACAAGGTGTACCTGTCCTGGGTGCCCGCCCACAAGGGCATCGGCGGCAACGAGCAGGTGGACAAGCTGGTG
TCCAACGGCATCCGCAAGGTGCTGTTCCTGGACGGCATCGACAAGGCCCAGGAGGAGCACGAGCGCTACCACTCCAACTGGCGCGCCATGGCCTCCGACTT
CAACCTGCCCCCCATCGTGGCCAAGGAGATCGTGGCCTCCTGCGACAAGTGCCAGCTGAAGGGCGAGGCCATGCACGGCCAGGTGGACTGCTCCCCCGGCA
TCTGGCAGCTGGACTGCACCCACCTGGAGGGCAAGATCATCCTGGTGGCCGTGCACGTGGCCTCCGGCTACATCGAGGCCGAGGTGATCCCCGCCGAGACC
GGCCAGGAGACCGCCTACTTCATCCTGAAGCTGGCCGGCCGCTGGCCCGTGAAGGTGATCCACACCGACAACGGCTCCAACTTCACCTCCGCCGCCGTGAA
GGCCGCCTGCTGGTGGGCCAACGTGACCCAGGAGTTCGGCATCCCCTACAACCCCCAGTCCCAGGGCGTGGTGGAGTCCATGAACAAGGAGCTGAAGAAGA
TCATCGGCCAGGTGCGCGACCAGGCCGAGCACCTGAAGACCGCCGTGCAGATGGCCGTGTTCATCCACAACTTCAAGCGCAAGGGCGGCATCGGCGGCTAC
TCCGCCGGCGAGCGCATCATCGACATCATCGCCTCCGACATCCAGACCAAGGAGCTGCAGAAGCAGATCACCAAGATCCAGAACTTCCGCGTGTACTACCG
CGACTCCCGCGACCCCATCTGGAAGGGCCCCGCCAAGCTGCTGTGGAAGGGCGAGGGCGCCGTGGTGATCCAGGACAACTCCGACATCAAGGTGGTGCCCC
GCCGCAAGGCCAAGATCATCCGCGACTACGGCAAGCAGATGGCCGGCGACGACTGCGTGGCCGGCCGCCAGGACGAGGACTAA

Fig. 120B

2003_CON_03_AB pol.OPT

TTCTTCCGCGAGAACCTGGCCTTCCAGCAGCGCGAGGCCCGCAAGTTCTCCTCCGAGCAGACCCGCGCCATCTCCCCCACCTCCCGCAAGCTGTGGGACGG
CGGCCGCGACAACCCCCTGCCCGAGACCGGCACCGAGCGCCAGGGCACCGCCTCCTCCTTCAACTTCCCCCAGATCACCCTGTGGCAGCGCCCCCTGGTGA
CCGTGCGCATCGGCGGCCAGCTGAAGGAGGCCCTGCTGGACACCGGCGCCGACGACACCGTGCTGGAGGACATCAACCTGCCCGGCAAGTGGAAGCCCAAG
ATGATCGGCGGCATCGGCGGCTTCATCAAGGTGCGCCAGTACGACCAGATCCTGATCGAGATCTGCGGCAAGAAGGCCATCGGCACCGTGCTGGTGGGCCC
CACCCCCGTGAACATCATCGGCCGCAACATGCTGACCCAGCTGGGCTGCACCCTGAACTTCCCCATCTCCCCCATCGAGACCGTGCCCGTGACCCTGAAGC
CCGGCATGGACGGCCCCAAGGTGAAGCAGTGGCCCCTGACCGAGGAGAAGATCAAGGCCCTGACCGACATCTGCAAGGAGATGGAGAAGGAGGGCAAGATC
TCCAAGATCGGCCCCGAGAACCCCTACAACACCCCCGTGTTCGCCATCAAGAAGAAGGACTCCACCAAGTGGCGCAAGCTGGTGGACTTCCGCGAGCTGAA
CAAGCGCACCCAGGACTTCTGGGAGGTGCAGCTGGGCATCCCCCACCCCGCCGGCCTGAAGAAGAAGAAGTCCGTGACCGTGCTGGACGTGGGCGACGCCT
ACTTCTCCGTGCCCCTGGACCAGGACTTCCGCAAGTACACCGCCTTCACCATCCCCTCCACCAACAACGAGACCCCCGGCATCCGCTACCAGTACAACGTG
CTGCCCCAGGGCTGGAAGGGCTCCCCCGCCATCTTCCAGTCCTCCATGACCAAGATCCTGGAGCCCTTCCGCAAGCAGAACCCCGAGATCGTGATCTACCA
GTACATGGACGACCTGTACGTGGGCTCCGACCTGGAGATCGGCCAGCACCGCACCAAGATCGAGGAGCTGCGCGAGCACCTGCTGCGCTGGGGCTTCACCA
CCCCCGACAAGAAGCACCAGAAGGAGCCCCCCTTCCTGTGGATGGGCTACGAGCTGCACCCCGACAAGTGGACCGTGCAGCCCATCGTGCTGCCCGAGAAG
GACTCCTGGACCGTGAACGACATCCAGAAGCTGGTGGGCAAGCTGAACTGGGCCTCCCAGATCTACGCCGGCATCAAGGTGCGCCAGCTGTGCAAGCTGCT
GCGCGGCGCCAAGGCCCTGACCGAGGTGATCCCCCTGACCGCCGAGGCCGAGCTGGAGCTGGCCGAGAACCGCGAGATCCTGAAGGAGCCCGTGCACGGCG
TGTACTACGACCCCTCCAAGGACCTGGTGGCCGAGATCCAGAAGCAGGGCCAGGGCCAGTGGACCTACCAGATCTACCAGGAGCCCTTCAAGAACCTGAAG
ACCGGCAAGTACGCCCGCCTGCGCGGCGCCCACACCAACGACGTGAAGCAGCTGACCGAGGCCGTGCAGAAGATCGCCACCGAGTCCATCGTGATCTGGGG
CAAGACCCCCAAGTTCAAGCTGCCCATCCAGAAGGAGACCTGGGAGACCTGGTGGACCGAGTACTGGCAGGCCACCTGGATCCCCGAGTGGGAGTTCGTGA
ACACCCCCCCCCTGGTGAAGCTGTGGTACCAGCTGGAGAAGGAGCCCATCGTGGGCGCCGAGACCTTCTACGTGGACGGCGCCGCCAACCGCGAGACCAAG
TCCGGCAAGGCCGGCTACGTGACCGACCGCGGCCGCCAGAAGGTGGTGTCCCTGACCGACACCACCAACCAGAAGACCGAGCTGCAGGCCATCCACCTGGC
CCTGCAGGACTCCGGCCTGGAGGTGAACATCGTGACCGACTCCCAGTACGCCCTGGGCATCATCCAGGCCCAGCCCGACAAGTCCGAGTCCGAGCTGGTGT
CCCAGATCATCGAGCAGCTGATCAAGAAGGAGAAGGTGTACCTGGCCTGGGTGCCCGCCCACAAGGGCATCGGCGGCAACGAGCAGGTGGACAAGCTGGTG
TCCGCCGGCATCCGCAAGGTGCTGTTCCTGGACGGCATCGACAAGGCCCAGGAGGCCCACGAGAAGTACCACTCCAACTGGCGCGCCATGGCCTCCGACTT
CAACCTGCCCCCCGTGGTGGCCAAGGAGATCGTGGCCTCCTGCGACAAGTGCCAGCTGAAGGGCGAGGCCATGCACGGCCAGGTGGACTGCTCCCCCGGCA
TCTGGCAGCTGGACTGCACCCACCTGGAGGGCAAGATCATCCTGGTGGCCGTGCACGTGGCCTCCGGCTACATCGAGGCCGAGGTGATCCCCGCCGAGACC
GGCCAGGAGACCGCCTACTTCGTGCTGAAGCTGGCCGGCCGCTGGCCCGTGAAGATCATCCACACCGACAACGGCTCCAACTTCATCTCCACCGCCGTGAA
GGCCGCCTGCTGGTGGGCCGGCATCAAGCAGGAGTTCGGCATCCCCTACAACCCCCAGTCCCAGGGCGTGGTGGAGTCCATGAACAAGCAGCTGAAGCAGA
TCATCGGCCAGGTGCGCGACCAGGCCGAGCACCTGAAGACCGCCGTGCAGATGGCCGTGTTCATCCACAACTTCAAGCGCAAGGGCGGCATCGGCGGCTAC
TCCGCCGGCGAGCGCATCATCGACATCATCGCCACCGACATCCAGACCAAGGAGCTGCAGAAGCAGATCATCAAGATCCAGAACTTCCGCGTGTACTACCG
CGACTCCCGCGACCCCATCTGGAAGGGCCCCGCCAAGCTGCTGTGGAAGGGCGAGGGCGCCGTGGTGATCCAGGACAACAACGACATCAAGGTGGTGCCCC
GCCGCAAGGCCAAGATCATCCGCGACTACGGCAAGCAGATGGCCGGCGACGACTGCGTGGCCTCCCGCCAGGACGAGGACTAA

Fig. 121A

78. 2003_CON_04_CPX pol.PEP

FFRENVAFQQREARKFSSEQARANSPARRELRDERGDNLLSEAGTEGQGTISFNFPQITLWQRPLVTIKIGGQIREALLDTGADDTVLEEIN
LPGKWKPKMIGGIGGFIKVRQYDQIPIEICGKKAIGTVLVGPTPVNIIGRNMLTQLGCTLNFPISPIETVPVKLKPGMDGPKVKQWPLTEEK
IKALTEICTEMEKEGKISKIGPENPYNTPIFAIKKKNSTRWRKLVDFRELNKRTQDFWEVQLGIPHPAGLKKKKSVTVLDVGDAYFSVPLDP
EFRKYTAFTIPSTNNETPGIRYQYNVLPQGWKGSPAIFQCSMTKILEPFRTKNPEIVIYQYMDDLYVGSDLEIGQHRAKIEELREHLLRWGF
STPDKKHQKEPPFLWMGYELHPDKWTVQPIQLAEKDSWTVNDIQKLVGKLNWASQIYPGIKVKQLCKLLRGAKALTDIVPLTTEAELELAEN
REILKEPVHGAYYDPSKDLIAEIQKQGQGQWTYQIYQEPYKNLKTGKYAKTRSAHTNDVRQLTEAVQKIAMECIVIWGKTPKFRLPIQKETW
DTWWTEYWQATWIPEWEFVNTPPLVKLWYQLETDPIAGAETFYVDGAASRETKQGKAGYVTDRGRQKVVSLSETTNQKTELQAIYLALQDSG
SEVNIVTDSQYAIGIIQAQPDRSESDLVNQIIEQLIQKDKVYLSWVPAHKGIGGNEQVDKLVSNGIRKVLFLDGIDKAQEEHEKYHNNWRAM
ASDFNLPPVVAKEIVASCNKCQLKGEAMHGQVDCSPGIWQLDCTHLEGKIILVAVHVASGYIEAEVIPAETGQETAYFILKLAGRWPVKIIH
TDNGPNFTSAAVKAACWWADIQQEFGIPYNPQSQGVVESMNKELKKIIGQVRDQAEHLKTAVQMAVFIHNFKRKGGIGGYSAGERIIDIIAS
DIQTKELQKQITKIQNFRVYYRDSRDPIWKGPAKLLWKGEGAVVIQDNSDIKVVPRRKAKIIRDYGKQMAGDDCVAGRQDED$

Fig. 122A

79. 2003_CON_06_CPX pol.PEP

FFRENLAFQQGEAREFSSEQARANSPTRRELRVRRGDSPLPEAGAEGQGAISLSFPQITLWQRPLVTVRIGGQLIEALLDTGADDTVLEDIN
LPGKWKPKMIGGIGGFIKVRQYDQILIEICGKKAIGTVLVGPTPVNIIGRNMLTQIGCTLNFPISPIETVPVKLKPGMDGPKVKQWPLTEEK
IKALTEICTEMEKEGKISKIGPENPYNTPIFAIKKKDSTKWRKLVDFRELNKRTQDFWEVQLGIPHPAGLKKKKSVTVLDVGDAYFSVPLDE
DFRKYTAFTIPSINNETPGIRYQYNVLPQGWKGSPAIFQSSMIKILEPFRIKNPEIVIYQYMDDLYVGSDLEIGQHRAKIEELREHLLKWGF
TTPDKKHQKEPPFLWMGYELHPDKWTVQPIQLPDKDSWTVNDIQKLVGKLNWASQIYPGIKVKQLCKLLRGAKALTDIVPLTAEAELELAEN
REILKEPVHGVYYDPSKDLIAEIQKQGQGQWTYQIYQEPHKNLKTGKYARIKSAHTNDVKQLTEAVQKIALESIVIWGKTPKFRLPIQKETW
ETWWTEYWQATWIPEWEFVNTPPLVKLWYQLETEPIVGAETFYVDGAANRETKKGKAGYVTDRGRQKVVSLTETTNQKTELQAINLALQDSG
SEVNIVTDSQYALGIIQAQPDKSESELVNQIIEQLIKKEKVYLSWVPAHKGIGGNEQVDKLVSTGIRKVLFLDGIDKAQEDHERYHSNWRAM
ASDFNLPPIVAKEIVASCDKCQLKGEAMHGQVDCSPGIWQLDCTHLEGKIILVAVHVASGYIEAEVIPAETGQETAYFILKLAGRWPVKVIH
TDNGSNFTSAAVKAACWWANITQEFGIPYNPQSQGVVESMNKELKKIIGQVRDQAEHLKTAVQMAVFIHNFKRKGGIGGYSAGERIIDIIAS
DIQTKELQKQITKIQNFRVYYRDSRDPIWKGPAKLLWKGEGAVVIQDNSEIKVVPRRKAKIIRDYGKQMAGDDCVAGRQDED$

Fig. 121B

2003_CON_04_CPX pol.OPT

TTCTTCCGCGAGAACGTGGCCTTCCAGCAGCGCGAGGCCCGCAAGTTCTCCTCCGAGCAGGCCCGCGCCAACTCCCCCGCCCGCCGCGAGCTGCGCGACGA
GCGCGGCGACAACCTGCTGTCCGAGGCCGGCACCGAGGGCCAGGGCACCATCTCCTTCAACTTCCCCCAGATCACCCTGTGGCAGCGCCCCCTGGTGACCA
TCAAGATCGGCGGCCAGATCCGCGAGGCCCTGCTGGACACCGGCGCCGACGACACCGTGCTGGAGGAGATCAACCTGCCCGGCAAGTGGAAGCCCAAGATG
ATCGGCGGCATCGGCGGCTTCATCAAGGTGCGCCAGTACGACCAGATCCCCATCGAGATCTGCGGCAAGAAGGCCATCGGCACCGTGCTGGTGGGCCCCAC
CCCCGTGAACATCATCGGCCGCAACATGCTGACCCAGCTGGGCTGCACCCTGAACTTCCCCATCTCCCCCATCGAGACCGTGCCCGTGAAGCTGAAGCCCG
GCATGGACGGCCCCAAGGTGAAGCAGTGGCCCCTGACCGAGGAGAAGATCAAGGCCCTGACCGAGATCTGCACCGAGATGGAGAAGGAGGGCAAGATCTCC
AAGATCGGCCCCGAGAACCCCTACAACACCCCCATCTTCGCCATCAAGAAGAAGAACTCCACCCGCTGGCGCAAGCTGGTGGACTTCCGCGAGCTGAACAA
GCGCACCCAGGACTTCTGGGAGGTGCAGCTGGGCATCCCCCACCCCGCCGGCCTGAAGAAGAAGAAGTCCGTGACCGTGCTGGACGTGGGCGACGCCTACT
TCTCCGTGCCCCTGGACCCCGAGTTCCGCAAGTACACCGCCTTCACCATCCCCTCCACCAACAACGAGACCCCCGGCATCCGCTACCAGTACAACGTGCTG
CCCCAGGGCTGGAAGGGCTCCCCCGCCATCTTCCAGTGCTCCATGACCAAGATCCTGGAGCCCTTCCGCACCAAGAACCCCGAGATCGTGATCTACCAGTA
CATGGACGACCTGTACGTGGGCTCCGACCTGGAGATCGGCCAGCACCGCGCCAAGATCGAGGAGCTGCGCGAGCACCTGCTGCGCTGGGGCTTCTCCACCC
CCGACAAGAAGCACCAGAAGGAGCCCCCCTTCCTGTGGATGGGCTACGAGCTGCACCCCGACAAGTGGACCGTGCAGCCCATCCAGCTGGCCGAGAAGGAC
TCCTGGACCGTGAACGACATCCAGAAGCTGGTGGGCAAGCTGAACTGGGCCTCCCAGATCTACCCCGGCATCAAGGTGAAGCAGCTGTGCAAGCTGCTGCG
CGGCGCCAAGGCCCTGACCGACATCGTGCCCCTGACCACCGAGGCCGAGCTGGAGCTGGCCGAGAACCGCGAGATCCTGAAGGAGCCCGTGCACGGCGCCT
ACTACGACCCCTCCAAGGACCTGATCGCCGAGATCCAGAAGCAGGGCCAGGGCCAGTGGACCTACCAGATCTACCAGGAGCCCTACAAGAACCTGAAGACC
GGCAAGTACGCCAAGACCCGCTCCGCCCACACCAACGACGTGCGCCAGCTGACCGAGGCCGTGCAGAAGATCGCCATGGAGTGCATCGTGATCTGGGGCAA
GACCCCCAAGTTCCGCCTGCCCATCCAGAAGGAGACCTGGGACACCTGGTGGACCGAGTACTGGCAGGCCACCTGGATCCCCGAGTGGGAGTTCGTGAACA
CCCCCCCCCTGGTGAAGCTGTGGTACCAGCTGGAGACCGACCCCATCGCCGGCGCCGAGACCTTCTACGTGGACGGCGCCGCCTCCCGCGAGACCAAGCAG
GGCAAGGCCGGCTACGTGACCGACCGCGGCCGCCAGAAGGTGGTGTCCCTGTCCGAGACCACCAACCAGAAGACCGAGCTGCAGGCCATCTACCTGGCCCT
GCAGGACTCCGGCTCCGAGGTGAACATCGTGACCGACTCCCAGTACGCCATCGGCATCATCCAGGCCCAGCCCGACCGCTCCGAGTCCGACCTGGTGAACC
AGATCATCGAGCAGCTGATCCAGAAGGACAAGGTGTACCTGTCCTGGGTGCCCGCCCACAAGGGCATCGGCGGCAACGAGCAGGTGGACAAGCTGGTGTCC
AACGGCATCCGCAAGGTGCTGTTCCTGGACGGCATCGACAAGGCCCAGGAGGAGCACGAGAAGTACCACAACAACTGGCGCGCCATGGCCTCCGACTTCAA
CCTGCCCCCCGTGGTGGCCAAGGAGATCGTGGCCTCCTGCAACAAGTGCCAGCTGAAGGGCGAGGCCATGCACGGCCAGGTGGACTGCTCCCCCGGCATCT
GGCAGCTGGACTGCACCCACCTGGAGGGCAAGATCATCCTGGTGGCCGTGCACGTGGCCTCCGGCTACATCGAGGCCGAGGTGATCCCCGCCGAGACCGGC
CAGGAGACCGCCTACTTCATCCTGAAGCTGGCCGGCCGCTGGCCCGTGAAGATCATCCACACCGACAACGGCCCCAACTTCACCTCCGCCGCCGTGAAGGC
CGCCTGCTGGTGGGCCGACATCCAGCAGGAGTTCGGCATCCCCTACAACCCCCAGTCCCAGGGCGTGGTGGAGTCCATGAACAAGGAGCTGAAGAAGATCA
TCGGCCAGGTGCGCGACCAGGCCGAGCACCTGAAGACCGCCGTGCAGATGGCCGTGTTCATCCACAACTTCAAGCGCAAGGGCGGCATCGGCGGCTACTCC
GCCGGCGAGCGCATCATCGACATCATCGCCTCCGACATCCAGACCAAGGAGCTGCAGAAGCAGATCACCAAGATCCAGAACTTCCGCGTGTACTACCGCGA
CTCCCGCGACCCCATCTGGAAGGGCCCCGCCAAGCTGCTGTGGAAGGGCGAGGGCGCCGTGGTGATCCAGGACAACTCCGACATCAAGGTGGTGCCCCGCC
GCAAGGCCAAGATCATCCGCGACTACGGCAAGCAGATGGCCGGCGACGACTGCGTGGCCGGCCGCCAGGACGAGGACTAA

Fig. 122B

2003_CON_06_CPX pol.OPT

TTCTTCCGCGAGAACCTGGCCTTCCAGCAGGGCGAGGCCCGCGAGTTCTCCTCCGAGCAGGCCCGCGCCAACTCCCCCACCCGCCGCGAGCTGCGCGTGCG
CCGCGGCGACTCCCCCCTGCCCGAGGCCGGCGCCGAGGGCCAGGGCGCCATCTCCCTGTCCTTCCCCCAGATCACCCTGTGGCAGCGCCCCCTGGTGACCG
TGCGCATCGGCGGCCAGCTGATCGAGGCCCTGCTGGACACCGGCGCCGACGACACCGTGCTGGAGGACATCAACCTGCCCGGCAAGTGGAAGCCCAAGATG
ATCGGCGGCATCGGCGGCTTCATCAAGGTGCGCCAGTACGACCAGATCCTGATCGAGATCTGCGGCAAGAAGGCCATCGGCACCGTGCTGGTGGGCCCCAC
CCCCGTGAACATCATCGGCCGCAACATGCTGACCCAGATCGGCTGCACCCTGAACTTCCCCATCTCCCCCATCGAGACCGTGCCCGTGAAGCTGAAGCCCG
GCATGGACGGCCCCAAGGTGAAGCAGTGGCCCCTGACCGAGGAGAAGATCAAGGCCCTGACCGAGATCTGCACCGAGATGGAGAAGGAGGGCAAGATCTCC
AAGATCGGCCCCGAGAACCCCTACAACACCCCCATCTTCGCCATCAAGAAGAAGGACTCCACCAAGTGGCGCAAGCTGGTGGACTTCCGCGAGCTGAACAA
GCGCACCCAGGACTTCTGGGAGGTGCAGCTGGGCATCCCCCACCCCGCCGGCCTGAAGAAGAAGAAGTCCGTGACCGTGCTGGACGTGGGCGACGCCTACT
TCTCCGTGCCCCTGGACGAGGACTTCCGCAAGTACACCGCCTTCACCATCCCCTCCATCAACAACGAGACCCCCGGCATCCGCTACCAGTACAACGTGCTG
CCCCAGGGCTGGAAGGGCTCCCCCGCCATCTTCCAGTCCTCCATGATCAAGATCCTGGAGCCCTTCCGCATCAAGAACCCCGAGATCGTGATCTACCAGTA
CATGGACGACCTGTACGTGGGCTCCGACCTGGAGATCGGCCAGCACCGCGCCAAGATCGAGGAGCTGCGCGAGCACCTGCTGAAGTGGGGCTTCACCACCC
CCGACAAGAAGCACCAGAAGGAGCCCCCCTTCCTGTGGATGGGCTACGAGCTGCACCCCGACAAGTGGACCGTGCAGCCCATCCAGCTGCCCGACAAGGAC
TCCTGGACCGTGAACGACATCCAGAAGCTGGTGGGCAAGCTGAACTGGGCCTCCCAGATCTACCCCGGCATCAAGGTGAAGCAGCTGTGCAAGCTGCTGCG
CGGCGCCAAGGCCCTGACCGACATCGTGCCCCTGACCGCCGAGGCCGAGCTGGAGCTGGCCGAGAACCGCGAGATCCTGAAGGAGCCCGTGCACGGCGTGT
ACTACGACCCCTCCAAGGACCTGATCGCCGAGATCCAGAAGCAGGGCCAGGGCCAGTGGACCTACCAGATCTACCAGGAGCCCCACAAGAACCTGAAGACC
GGCAAGTACGCCCGCATCAAGTCCGCCCACACCAACGACGTGAAGCAGCTGACCGAGGCCGTGCAGAAGATCGCCCTGGAGTCCATCGTGATCTGGGGCAA
GACCCCCAAGTTCCGCCTGCCCATCCAGAAGGAGACCTGGGAGACCTGGTGGACCGAGTACTGGCAGGCCACCTGGATCCCCGAGTGGGAGTTCGTGAACA
CCCCCCCCCTGGTGAAGCTGTGGTACCAGCTGGAGACCGAGCCCATCGTGGGCGCCGAGACCTTCTACGTGGACGGCGCCGCCAACCGCGAGACCAAGAAG
GGCAAGGCCGGCTACGTGACCGACCGCGGCCGCCAGAAGGTGGTGTCCCTGACCGAGACCACCAACCAGAAGACCGAGCTGCAGGCCATCAACCTGGCCCT
GCAGGACTCCGGCTCCGAGGTGAACATCGTGACCGACTCCCAGTACGCCCTGGGCATCATCCAGGCCCAGCCCGACAAGTCCGAGTCCGAGCTGGTGAACC
AGATCATCGAGCAGCTGATCAAGAAGGAGAAGGTGTACCTGTCCTGGGTGCCCGCCCACAAGGGCATCGGCGGCAACGAGCAGGTGGACAAGCTGGTGTCC
ACCGGCATCCGCAAGGTGCTGTTCCTGGACGGCATCGACAAGGCCCAGGAGGACCACGAGCGCTACCACTCCAACTGGCGCGCCATGGCCTCCGACTTCAA
CCTGCCCCCCATCGTGGCCAAGGAGATCGTGGCCTCCTGCGACAAGTGCCAGCTGAAGGGCGAGGCCATGCACGGCCAGGTGGACTGCTCCCCCGGCATCT
GGCAGCTGGACTGCACCCACCTGGAGGGCAAGATCATCCTGGTGGCCGTGCACGTGGCCTCCGGCTACATCGAGGCCGAGGTGATCCCCGCCGAGACCGGC
CAGGAGACCGCCTACTTCATCCTGAAGCTGGCCGGCCGCTGGCCCGTGAAGGTGATCCACACCGACAACGGCTCCAACTTCACCTCCGCCGCCGTGAAGGC
CGCCTGCTGGTGGGCCAACATCACCCAGGAGTTCGGCATCCCCTACAACCCCCAGTCCCAGGGCGTGGTGGAGTCCATGAACAAGGAGCTGAAGAAGATCA
TCGGCCAGGTGCGCGACCAGGCCGAGCACCTGAAGACCGCCGTGCAGATGGCCGTGTTCATCCACAACTTCAAGCGCAAGGGCGGCATCGGCGGCTACTCC
GCCGGCGAGCGCATCATCGACATCATCGCCTCCGACATCCAGACCAAGGAGCTGCAGAAGCAGATCACCAAGATCCAGAACTTCCGCGTGTACTACCGCGA
CTCCCGCGACCCCATCTGGAAGGGCCCCGCCAAGCTGCTGTGGAAGGGCGAGGGCGCCGTGGTGATCCAGGACAACTCCGAGATCAAGGTGGTGCCCCGCC
GCAAGGCCAAGATCATCCGCGACTACGGCAAGCAGATGGCCGGCGACGACTGCGTGGCCGGCCGCCAGGACGAGGACTAA

Fig. 123A

80. 2003_CON_08_BC pol.PEP

FFREILAFPQGEAREFPPEQTRANSPTSRELQVRGDNPSSEAGTERQGTLNFPQITLWQRPLVSIKVGGQIKEALLDTGADDTVLEEVNLPG
KWKPKMIGGIGGFIKVRQYEQIPIEICGKKAIGTVLVGPTPVNIIGRNMLTQLGCTLNFPISPIETVPVKLKPGMDGPKVKQWPLTEEKIKA
LTAICDEMEKEGKITKIGPDNPYNTPIFAIRKKDSSKWRKLVDFRELNKRTQDFWEVQLGIPHPAGLKKKKSVTVLDVGDAYFSVPLDKDFR
KYTAFTIPSVNNETPGIRYQYNVLPQGWKGSPAIFQCSMTKILEPFRKQNPDIVIYQYMDDLYVGSDLEIGQHRTKIEELREHLLKWGFTTP
DKKHQKEPPFLWMGYELHPDKWTVQPIQLPEKDSWTVNDIQKLVGKLNWASQIYPGIKVRQLCKLLRGAKALTDIVPLTEEAELELAENREI
LKEPVHGAYYDPSKELIAEIQKQGQDQWTYQIYQEPFKNLKTGKYAKMRTAHTNDVKQLTEAVQKIAMESIVIWGKIPKFRLPIQKETWETW
WTDYWQATWIPEWEFVNTPPLVKLWYQLEKDPIAGVETFYVDGAANRETKIGKAGYVTDRGRKKIVSLTDTTNQKTELQAIYIALQDSGSEV
NIVTDSQYALGIIQAQPDKSESELVNQIIEQLIKKERVYLSWVPAHKGIGGNEQVDKLVSNGIRKVLFLDGIDKAQEEHEKYHSNWRAMASD
FNLPPIVAKEIVASCDQCQLKGEAMHGQVDCSPGIWQLDCTHLEGKIILVAVHVASGYIEAEVIPAETGQETAYFILKLAGRWPVKVIHTDN
GSNFTSAAVKAACWWAGIQQEFGIPYNPQSQGVVESMNKELKKLIGQVRDQAEHLKTAVQMAVFIHNFKRKGGIGGYSAGERIVDIIATDIQ
TRELQKQIIKIQNFRVYYRDSRDPIWKGPAKLLWKGEGAVVIQDNSDIKVVPRRKAKIIKDYGKQMAGADCVAGRQDED$

Fig. 124A

81. 2003_CON_10_CD pol.PEP

FFRENLAFQQRKARELPSEQTRANSPTSRELRVWGGDNTLSETGAERQGAVSLSFPQITLWQRPLVTVKIGGQLKEALLDTGADDTVLEEMN
LPGKWKPKMIGGIGGFIKVRQYDQILIEICGYKAIGTVLVGPTPVNIIGRNLLTQIGCTLNFPISPIETVPVKLKPGMDGPKVKQWPLTEEK
IKALTEICTEMEKEGKISRIGPENPYNTPIFAIKKKDSTKWRKLVDFRELNKRTQDFWEVQLGIPHPAGLKKKKSVTVLDVGDAYFSVPLYE
DFRKYTAFTIPSINNETPGIRYQYNVLPQGWKGSPAIFQSSMTKILEPFRKQNPEMVIYQYMDDLYVGSDLEIGQHRIKIEELRGHLLKWGF
TTPDKKHQKEPPFLWMGYELHPDKWTVQPIQLPEKDSWTVNDIQKLVGKLNWASQIYPGIKVRQLCKLLRGAKALTDIVPLTEEAELELAEN
REILKEPVHGVYYDPSKDLIAEIQKQGQDQWTYQIYQEPHKNLKTGKYAKRRTAHTNDVKQLTEAVQKIAQESIVIWGKTPKFRLPIQKETW
ETWWTDYWQATWIPEWEFVNTPPLVKLWYQLEKEPIVGAETFYVDGAANRETKLGKAGYVTDRGRQKVISITDTTNQKTELQAINLALQDSG
SEVNIVTDSQYALGIIQAQPDKSESELVNQIIEQLIKKEKVYLSWVPAHKGIGGNEQVDKLVSSGIRKVLFLDGIDKAQEEHEKYHNNWRAM
ASDFNLPPVVAKEIVASCDKCQLKGEALHGQVDCSPGIWQLDCTHLEGKVILVAVHVASGYIEAEVIPAETGQETAYFLLKLAGRWPVKVVH
TDNGSNFTSAAVKAACWWAGIKQEFGIPYNPQSQGVVESMNKELKKIIGQVRDQAEHLKTAVQMAVFIHNFKRKGGIGGYSAGERIIDIIAT
DIQTKELQKQIIKIQNFRVYYRDSRDPIWKGPAKLLWKGEGAVVIQDNSDIKVVPRRKVKIIKDYGKQMAGADCVASRQDEDQ

Fig. 123B

2003_CON_08_BC pol.OPT

TTCTTCCGCGAGATCCTGGCCTTCCCCCAGGGCGAGGCCCGCGAGTTCCCCCCGAGCAGACCCGCGCCAACTCCCCCACCTCCCGCGAGCTGCAGGTGCG
CGGCGACAACCCCTCCTCCGAGGCCGGCACCGAGCGCCAGGGCACCCTGAACTTCCCCCAGATCACCCTGTGGCAGCGCCCCCTGGTGTCCATCAAGGTGG
GCGGCCAGATCAAGGAGGCCCTGCTGGACACCGGCGCCGACGACACCGTGCTGGAGGAGGTGAACCTGCCCGGCAAGTGGAAGCCCAAGATGATCGGCGGC
ATCGGCGGCTTCATCAAGGTGCGCCAGTACGAGCAGATCCCCATCGAGATCTGCGGCAAGAAGGCCATCGGCACCGTGCTGGTGGGCCCCACCCCCGTGAA
CATCATCGGCCGCAACATGCTGACCCAGCTGGGCTGCACCCTGAACTTCCCCATCTCCCCCATCGAGACCGTGCCCGTGAAGCTGAAGCCCGGCATGGACG
GCCCCAAGGTGAAGCAGTGGCCCCTGACCGAGGAGAAGATCAAGGCCCTGACCGCCATCTGCGACGAGATGGAGAAGGAGGGCAAGATCACCAAGATCGGC
CCCGACAACCCCTACAACACCCCCATCTTCGCCATCCGCAAGAAGGACTCCTCCAAGTGGCGCAAGCTGGTGGACTTCCGCGAGCTGAACAAGCGCACCCA
GGACTTCTGGGAGGTGCAGCTGGGCATCCCCCACCCCGCCGGCCTGAAGAAGAAGAAGTCCGTGACCGTGCTGGACGTGGGCGACGCCTACTTCTCCGTGC
CCCTGGACAAGGACTTCCGCAAGTACACCGCCTTCACCATCCCCTCCGTGAACAACGAGACCCCCGGCATCCGCTACCAGTACAACGTGCTGCCCCAGGGC
TGGAAGGGCTCCCCCGCCATCTTCCAGTGCTCCATGACCAAGATCCTGGAGCCCTTCCGCAAGCAGAACCCCGACATCGTGATCTACCAGTACATGGACGA
CCTGTACGTGGGCTCCGACCTGGAGATCGGCCAGCACCGCACCAAGATCGAGGAGCTGCGCGAGCACCTGCTGAAGTGGGGCTTCACCACCCCCGACAAGA
AGCACCAGAAGGAGCCCCCCTTCCTGTGGATGGGCTACGAGCTGCACCCCGACAAGTGGACCGTGCAGCCCATCCAGCTGCCCGAGAAGGACTCCTGGACC
GTGAACGACATCCAGAAGCTGGTGGGCAAGCTGAACTGGGCCTCCCAGATCTACCCCGGCATCAAGGTGCGCCAGCTGTGCAAGCTGCTGCGCGGCGCCAA
GGCCCTGACCGACATCGTGCCCCTGACCGAGGAGGCCGAGCTGGAGCTGGCCGAGAACCGCGAGATCCTGAAGGAGCCCGTGCACGGCGCCTACTACGACC
CCTCCAAGGAGCTGATCGCCGAGATCCAGAAGCAGGGCCAGGACCAGTGGACCTACCAGATCTACCAGGAGCCCTTCAAGAACCTGAAGACCGGCAAGTAC
GCCAAGATGCGCACCGCCCACACCAACGACGTGAAGCAGCTGACCGAGGCCGTGCAGAAGATCGCCATGGAGTCCATCGTGATCTGGGGCAAGATCCCCAA
GTTCCGCCTGCCCATCCAGAAGGAGACCTGGGAGACCTGGTGGACCGACTACTGGCAGGCCACCTGGATCCCCGAGTGGGAGTTCGTGAACACCCCCCCC
TGGTGAAGCTGTGGTACCAGCTGGAGAAGGACCCCATCGCCGGCGTGGAGACCTTCTACGTGGACGGCGCCGCCAACCGCGAGACCAAGATCGGCAAGGCC
GGCTACGTGACCGACCGCGGCCGCAAGAAGATCGTGTCCCTGACCGACACCACCAACCAGAAGACCGAGCTGCAGGCCATCTACATCGCCCTGCAGGACTC
CGGCTCCGAGGTGAACATCGTGACCGACTCCCAGTACGCCCTGGGCATCATCCAGGCCCAGCCCGACAAGTCCGAGTCCGAGCTGGTGAACCAGATCATCG
AGCAGCTGATCAAGAAGGAGCGCGTGTACCTGTCCTGGGTGCCCGCCCACAAGGGCATCGGCGGCAACGAGCAGGTGGACAAGCTGGTGTCCAACGGCATC
CGCAAGGTGCTGTTCCTGGACGGCATCGACAAGGCCCAGGAGGAGCACGAGAAGTACCACTCCAACTGGCGCGCCATGGCCTCCGACTTCAACCTGCCCCC
CATCGTGGCCAAGGAGATCGTGGCCTCCTGCGACCAGTGCCAGCTGAAGGGCGAGGCCATGCACGGCCAGGTGGACTGCTCCCCCGGCATCTGGCAGCTGG
ACTGCACCCACCTGGAGGGCAAGATCATCCTGGTGGCCGTGCACGTGGCCTCCGGCTACATCGAGGCCGAGGTGATCCCCGCCGAGACCGGCCAGGAGACC
GCCTACTTCATCCTGAAGCTGGCCGGCCGCTGGCCCGTGAAGGTGATCCACACCGACAACGGCTCCAACTTCACCTCCGCCGCCGTGAAGGCCGCCTGCTG
GTGGGCCGGCATCCAGCAGGAGTTCGGCATCCCCTACAACCCCCAGTCCCAGGGCGTGGTGGAGTCCATGAACAAGGAGCTGAAGAAGCTGATCGGCCAGG
TGCGCGACCAGGCCGAGCACCTGAAGACCGCCGTGCAGATGGCCGTGTTCATCCACAACTTCAAGCGCAAGGGCGGCATCGGCGGCTACTCCGCCGGCGAG
CGCATCGTGGACATCATCGCCACCGACATCCAGACCCGCGAGCTGCAGAAGCAGATCATCAAGATCCAGAACTTCCGCGTGTACTACCGCGACTCCCGCGA
CCCCATCTGGAAGGGCCCCGCCAAGCTGCTGTGGAAGGGCGAGGGCGCCGTGGTGATCCAGGACAACTCCGACATCAAGGTGGTGCCCCGCCGCAAGGCCA
AGATCATCAAGGACTACGGCAAGCAGATGGCCGGCGCCGACTGCGTGGCCGGCCGCCAGGACGAGGACTAA

Fig. 124B

2003_CON_10_CD pol.OPT

TTCTTCCGCGAGAACCTGGCCTTCCAGCAGCGCAAGGCCCGCGAGCTGCCCTCCGAGCAGACCCGCGCCAACTCCCCCACCTCCCGCGAGCTGCGCGTGTG
GGGCGGCGACAACACCCTGTCCGAGACCGGCGCCGAGCGCCAGGGCGCCGTGTCCCTGTCCTTCCCCCAGATCACCCTGTGGCAGCGCCCCCTGGTGACCG
TGAAGATCGGCGGCCAGCTGAAGGAGGCCCTGCTGGACACCGGCGCCGACGACACCGTGCTGGAGGAGATGAACCTGCCCGGCAAGTGGAAGCCCAAGATG
ATCGGCGGCATCGGCGGCTTCATCAAGGTGCGCCAGTACGACCAGATCCTGATCGAGATCTGCGGCTACAAGGCCATCGGCACCGTGCTGGTGGGCCCCAC
CCCCGTGAACATCATCGGCCGCAACCTGCTGACCCAGATCGGCTGCACCCTGAACTTCCCCATCTCCCCCATCGAGACCGTGCCCGTGAAGCTGAAGCCCG
GCATGGACGGCCCCAAGGTGAAGCAGTGGCCCCTGACCGAGGAGAAGATCAAGGCCCTGACCGAGATCTGCACCGAGATGGAGAAGGAGGGCAAGATCTCC
CGCATCGGCCCCGAGAACCCCTACAACACCCCCATCTTCGCCATCAAGAAGAAGGACTCCACCAAGTGGCGCAAGCTGGTGGACTTCCGCGAGCTGAACAA
GCGCACCCAGGACTTCTGGGAGGTGCAGCTGGGCATCCCCCACCCCGCCGGCCTGAAGAAGAAGAAGTCCGTGACCGTGCTGGACGTGGGCGACGCCTACT
TCTCCGTGCCCCTGTACGAGGACTTCCGCAAGTACACCGCCTTCACCATCCCCTCCATCAACAACGAGACCCCCGGCATCCGCTACCAGTACAACGTGCTG
CCCCAGGGCTGGAAGGGCTCCCCCGCCATCTTCCAGTCCTCCATGACCAAGATCCTGGAGCCCTTCCGCAAGCAGAACCCCGAGATGGTGATCTACCAGTA
CATGGACGACCTGTACGTGGGCTCCGACCTGGAGATCGGCCAGCACCGCATCAAGATCGAGGAGCTGCGCGGCCACCTGCTGAAGTGGGGCTTCACCACCC
CCGACAAGAAGCACCAGAAGGAGCCCCCCTTCCTGTGGATGGGCTACGAGCTGCACCCCGACAAGTGGACCGTGCAGCCCATCCAGCTGCCCGAGAAGGAC
TCCTGGACCGTGAACGACATCCAGAAGCTGGTGGGCAAGCTGAACTGGGCCTCCCAGATCTACCCCGGCATCAAGGTGCGCCAGCTGTGCAAGCTGCTGCG
CGGCGCCAAGGCCCTGACCGACATCGTGCCCCTGACCGAGGAGGCCGAGCTGGAGCTGGCCGAGAACCGCGAGATCCTGAAGGAGCCCGTGCACGGCGTGT
ACTACGACCCCTCCAAGGACCTGATCGCCGAGATCCAGAAGCAGGGCCAGGACCAGTGGACCTACCAGATCTACCAGGAGCCCCACAAGAACCTGAAGACC
GGCAAGTACGCCAAGCGCCGCACCGCCCACACCAACGACGTGAAGCAGCTGACCGAGGCCGTGCAGAAGATCGCCCAGGAGTCCATCGTGATCTGGGGCAA
GACCCCCAAGTTCCGCCTGCCCATCCAGAAGGAGACCTGGGAGACCTGGTGGACCGACTACTGGCAGGCCACCTGGATCCCCGAGTGGGAGTTCGTGAACA
CCCCCCCCCTGGTGAAGCTGTGGTACCAGCTGGAGAAGGAGCCCATCGTGGGCGCCGAGACCTTCTACGTGGACGGCGCCGCCAACCGCGAGACCAAGCTG
GGCAAGGCCGGCTACGTGACCGACCGCGGCCGCCAGAAGGTGATCTCCATCACCGACACCACCAACCAGAAGACCGAGCTGCAGGCCATCAACCTGGCCCT
GCAGGACTCCGGCTCCGAGGTGAACATCGTGACCGACTCCCAGTACGCCCTGGGCATCATCCAGGCCCAGCCCGACAAGTCCGAGTCCGAGCTGGTGAACC
AGATCATCGAGCAGCTGATCAAGAAGGAGAAGGTGTACCTGTCCTGGGTGCCCGCCCACAAGGGCATCGGCGGCAACGAGCAGGTGGACAAGCTGGTGTCC
TCCGGCATCCGCAAGGTGCTGTTCCTGGACGGCATCGACAAGGCCCAGGAGGAGCACGAGAAGTACCACAACAACTGGCGCGCCATGGCCTCCGACTTCAA
CCTGCCCCCCGTGGTGGCCAAGGAGATCGTGGCCTCCTGCGACAAGTGCCAGCTGAAGGGCGAGGCCCTGCACGGCCAGGTGGACTGCTCCCCCGGCATCT
GGCAGCTGGACTGCACCCACCTGGAGGGCAAGGTGATCCTGGTGGCCGTGCACGTGGCCTCCGGCTACATCGAGGCCGAGGTGATCCCCGCCGAGACCGGC
CAGGAGACCGCCTACTTCCTGCTGAAGCTGGCCGGCCGCTGGCCCGTGAAGGTGGTGCACACCGACAACGGCTCCAACTTCACCTCCGCCGCCGTGAAGGC
CGCCTGCTGGTGGGCCGGCATCAAGCAGGAGTTCGGCATCCCCTACAACCCCCAGTCCCAGGGCGTGGTGGAGTCCATGAACAAGGAGCTGAAGAAGATCA
TCGGCCAGGTGCGCGACCAGGCCGAGCACCTGAAGACCGCCGTGCAGATGGCCGTGTTCATCCACAACTTCAAGCGCAAGGGCGGCATCGGCGGCTACTCC
GCCGGCGAGCGCATCATCGACATCATCGCCACCGACATCCAGACCAAGGAGCTGCAGAAGCAGATCATCAAGATCCAGAACTTCCGCGTGTACTACCGCGA
CTCCCGCGACCCCATCTGGAAGGGCCCCGCCAAGCTGCTGTGGAAGGGCGAGGGCGCCGTGGTGATCCAGGACAACTCCGACATCAAGGTGGTGCCCCGCC
GCAAGGTGAAGATCATCAAGGACTACGGCAAGCAGATGGCCGGCGCCGACTGCGTGGCCTCCCGCCAGGACGAGGACCAG

Fig. 125A

82. 2003_CON_11_CPX pol.PEP
FFRENLAFQQGEAREFSPEQARANSPTSRELRVRGGDSPLPETGAEGEGAISFNFPQITLWQRPLVTIKVAGQLKEALLDTGADDTVLEEID
LPGRWKPKMIGGIGGFIKVRQYEEIIIEIEGKKAIGTVLVGPTPVNIIGRNMLTQIGCTLNFPISPIDTVPVKLKPGMDGPKVKQWPLTEEK
IKALTEICTEMEKEGKISKIGPENPYNTPVFAIKKKDSTKWRKLVDFRELNKRTQDFWEVQLGIPHPAGLKKKKSVTVLDVGDAYFSVPLDE
SFRKYTAFTIPSINNETPGIRYQYNVLPQGWKGSPAIFQSSMTKILEPFRTQNPEIVIYQYMDDLYVGSDLEIGQHREKVEELRKHLLKWGF
TTPDKKHQKEPPFLWMGYELHPDKWTVQPIQLPDKECWTVNDIQKLVGKLNWASQIYPGIKVKQLCKLLRGTKALTDIVPLTAEAELELAEN
REILKEPVHGVYYDPSKDLIAEVQKQGLDQWTYQIYQEPFKNLKTGKYAKRRTAHTNDVRQLAEVVQKISMESIVIWGKIPKFRLPIQRETW
ETWWTDYWQATWIPEWEFVNTPPLVKLWYQLEKEPIIGAETFYVDGAANRETKLGKAGYVTDKGRQKVVTLTETTNQKTELEAIHLALQDSG
LEVNIVTDSQYALGIIQAQPDKSESELVSQIIEQLIKKEKVYLSWVPAHKGIGGNEQVDKLVSSGIRKVLFLDGIDKAQEEHERYHSNWRAM
ASDFNLPPIVAKEIVASCDKCQLKGEAMHGQVDCSPGIWQLDCTHLEGKIILVAVHVASGYIEAEVIPAETGQETAYFILKLAGRWPVKVIH
TDNGSNFTSAAVKAACWWANIQQEFGIPYNPQSQGVVESMNKELKKIIGQVREQAEHLKTAVQMAVFIHNFKRKGGIGGYSAGERIVDIIAT
DLQTKELQKQITKIQNFRVYYRDSRDPIWKGPAKLLWKGEGAVVIQDNSDIKVVPRRKAKIIRDYGKQMAGDDCVAGRQDED$

Fig. 126A

83. 2003_CON_12_BF pol.PEP
FFRENLAFQQGEARKFPSEQARANSPASRELWVRRGDNPLSEAGAERRGTVPSLSFPQITLWQRPLVTIKVGGQLKEALLDTGADDTVLEDI
NLPGKWKPKMIGGIGGFIKVKQYDNILIEICGHKAIGTVLVGPTPVNIIGRNLLTQLGCTLNFPISPIETVPVKLKPGMDGPKVKQWPLTEE
KIKALTEICTEMEKEGKISKIGPENPYNTPVFAIKKKDSTKWRKLVDFRELNKRTQDFWEVQLGIPHPAGLKKKKSVTVLDVGDAYFSVPLD
KDFRKYTAFTIPSVNNETPGIRYQYNVLPQGWKGSPAIFQSSMTKILEPFRKQNPDIVIYQYMDDLYVGSDLEIGQHRTKIEELRQHLLRWG
FTTPDKKHQKEPPFLWMGYELHPDKWTVQPIVLPEKDSWTVNDIQKLVGKLNWASQIYPGIKVKQLCRLLRGTKALTEVIPLTKEAELELAE
NREILKEPVHGVYYDPSKDLIAEIQKQGQGQWTYQIYQEPFKNLKTGKYARMRGAHTNDVKQLTEAVQKITTESIVIWGKTPKFRLPILKET
WDTWWTEYWQATWIPEWEFVNTPPLVKLWYQLETEPIAGAETFYVDGASNRETKKGKAGYVTDRGRQKAVSLTETTNQKAELHAIQLALQDS
GSEVNIVTDSQYALGIIQAQPDKSESELVNQIIEQLIKKEKVYLSWVPAHKGIGGNEQVDKLVSAGIRKILFLDGIDKAQEEHEKYHNNWRA
MASDFNLPPVVAKEIVASCDKCQLKGEAMHGQVDCSPGIWQLDCTHLEGKIILVAVHVASGYLEAEVIPAETGQETAYFILKLAGRWPVKTI
HTDNGPNFSSAAVKAACWWAGIQQEFGIPYNPQSQGVVESMNKELKKIIRQVRDQAEHLKTAVQMAVFIHNFKRKGGIGGYSAGERIIDIIS
TDIQTRELQKQIIKIQNFRVYYRDSRDPVWKGPAKLLWKGEGAVVIQDNSEIKVVPRRKAKIIRDYGKQMAGDDCVAGRQDED$

Fig. 125B

2003_CON_11_CPX pol.OPT

TTCTTCCGCGAGAACCTGGCCTTCCAGCAGGGCGAGGCCCGCGAGTTCTCCCCCGAGCAGGCCCGCGCCAACTCCCCCACCTCCCGCGAGCTGCGCGTGCG
CGGCGGCGACTCCCCCCTGCCCGAGACCGGCGCCGAGGGCGAGGGCGCCATCTCCTTCAACTTCCCCCAGATCACCCTGTGGCAGCGCCCCCTGGTGACCA
TCAAGGTGGCCGGCCAGCTGAAGGAGGCCCTGCTGGACACCGGCGCCGACGACACCGTGCTGGAGGAGATCGACCTGCCCGGCCGCTGGAAGCCCAAGATG
ATCGGCGGCATCGGCGGCTTCATCAAGGTGCGCCAGTACGAGGAGATCATCATCGAGATCGAGGGCAAGAAGGCCATCGGCACCGTGCTGGTGGGCCCCAC
CCCCGTGAACATCATCGGCCGCAACATGCTGACCCAGATCGGCTGCACCCTGAACTTCCCCATCTCCCCCATCGACACCGTGCCCGTGAAGCTGAAGCCCG
GCATGGACGGCCCCAAGGTGAAGCAGTGGCCCCTGACCGAGGAGAAGATCAAGGCCCTGACCGAGATCTGCACCGAGATGGAGAAGGAGGGCAAGATCTCC
AAGATCGGCCCCGAGAACCCCTACAACACCCCCGTGTTCGCCATCAAGAAGAAGGACTCCACCAAGTGGCGCAAGCTGGTGGACTTCCGCGAGCTGAACAA
GCGCACCCAGGACTTCTGGGAGGTGCAGCTGGGCATCCCCCACCCCGCCGGCCTGAAGAAGAAGAAGTCCGTGACCGTGCTGGACGTGGGCGACGCCTACT
TCTCCGTGCCCCTGGACGAGTCCTTCCGCAAGTACACCGCCTTCACCATCCCCTCCATCAACAACGAGACCCCCGGCATCCGCTACCAGTACAACGTGCTG
CCCCAGGGCTGGAAGGGCTCCCCCGCCATCTTCCAGTCCTCCATGACCAAGATCCTGGAGCCCTTCCGCACCCAGAACCCCGAGATCGTGATCTACCAGTA
CATGGACGACCTGTACGTGGGCTCCGACCTGGAGATCGGCCAGCACCGCGAGAAGGTGGAGGAGCTGCGCAAGCACCTGCTGAAGTGGGGCTTCACCACCC
CCGACAAGAAGCACCAGAAGGAGCCCCCCTTCCTGTGGATGGGCTACGAGCTGCACCCCGACAAGTGGACCGTGCAGCCCATCCAGCTGCCCGACAAGGAG
TGCTGGACCGTGAACGACATCCAGAAGCTGGTGGGCAAGCTGAACTGGGCCTCCCAGATCTACCCCGGCATCAAGGTGAAGCAGCTGTGCAAGCTGCTGCG
CGGCACCAAGGCCCTGACCGACATCGTGCCCCTGACCGCCGAGGCCGAGCTGGAGCTGGCCGAGAACCGCGAGATCCTGAAGGAGCCCGTGCACGGCGTGT
ACTACGACCCCTCCAAGGACCTGATCGCCGAGGTGCAGAAGCAGGGCCTGGACCAGTGGACCTACCAGATCTACCAGGAGCCCTTCAAGAACCTGAAGACC
GGCAAGTACGCCAAGCGCCGCACCGCCCACACCAACGACGTGCGCCAGCTGGCCGAGGTGGTGCAGAAGATCTCCATGGAGTCCATCGTGATCTGGGGCAA
GATCCCCAAGTTCCGCCTGCCCATCCAGCGCGAGACCTGGGAGACCTGGTGGACCGACTACTGGCAGGCCACCTGGATCCCCGAGTGGGAGTTCGTGAACA
CCCCCCCCCTGGTGAAGCTGTGGTACCAGCTGGAGAAGGAGCCCATCATCGGCGCCGAGACCTTCTACGTGGACGGCGCCGCCAACCGCGAGACCAAGCTG
GGCAAGGCCGGCTACGTGACCGACAAGGGCCGCCAGAAGGTGGTGACCCTGACCGAGACCACCAACCAGAAGACCGAGCTGGAGGCCATCCACCTGGCCCT
GCAGGACTCCGGCCTGGAGGTGAACATCGTGACCGACTCCCAGTACGCCCTGGGCATCATCCAGGCCCAGCCCGACAAGTCCGAGTCCGAGCTGGTGTCCC
AGATCATCGAGCAGCTGATCAAGAAGGAGAAGGTGTACCTGTCCTGGGTGCCCGCCCACAAGGGCATCGGCGGCAACGAGCAGGTGGACAAGCTGGTGTCC
TCCGGCATCCGCAAGGTGCTGTTCCTGGACGGCATCGACAAGGCCCAGGAGGAGCACGAGCGCTACCACTCCAACTGGCGCGCCATGGCCTCCGACTTCAA
CCTGCCCCCCATCGTGGCCAAGGAGATCGTGGCCTCCTGCGACAAGTGCCAGCTGAAGGGCGAGGCCATGCACGGCCAGGTGGACTGCTCCCCCGGCATCT
GGCAGCTGGACTGCACCCACCTGGAGGGCAAGATCATCCTGGTGGCCGTGCACGTGGCCTCCGGCTACATCGAGGCCGAGGTGATCCCCGCCGAGACCGGC
CAGGAGACCGCCTACTTCATCCTGAAGCTGGCCGGCCGCTGGCCCGTGAAGGTGATCCACACCGACAACGGCTCCAACTTCACCTCCGCCGCCGTGAAGGC
CGCCTGCTGGTGGGCCAACATCCAGCAGGAGTTCGGCATCCCCTACAACCCCCAGTCCCAGGGCGTGGTGGAGTCCATGAACAAGGAGCTGAAGAAGATCA
TCGGCCAGGTGCGCGAGCAGGCCGAGCACCTGAAGACCGCCGTGCAGATGGCCGTGTTCATCCACAACTTCAAGCGCAAGGGCGGCATCGGCGGCTACTCC
GCCGGCGAGCGCATCGTGGACATCATCGCCACCGACCTGCAGACCAAGGAGCTGCAGAAGCAGATCACCAAGATCCAGAACTTCCGCGTGTACTACCGCGA
CTCCCGCGACCCCATCTGGAAGGGCCCCGCCAAGCTGCTGTGGAAGGGCGAGGGCGCCGTGGTGATCCAGGACAACTCCGACATCAAGGTGGTGCCCCGCC
GCAAGGCCAAGATCATCCGCGACTACGGCAAGCAGATGGCCGGCGACGACTGCGTGGCCGGCCGCCAGGACGAGGACTAA

Fig. 126B

2003_CON_12_BF pol.OPT

TTCTTCCGCGAGAACCTGGCCTTCCAGCAGGGCGAGGCCCGCAAGTTCCCCTCCGAGCAGGCCCGCGCCAACTCCCCCGCCTCCCGCGAGCTGTGGGTGCG
CCGCGGCGACAACCCCCTGTCCGAGGCCGGCGCCGAGCGCCGCGGCACCGTGCCCTCCCTGTCCTTCCCCCAGATCACCCTGTGGCAGCGCCCCCTGGTGA
CCATCAAGGTGGGCGGCCAGCTGAAGGAGGCCCTGCTGGACACCGGCGCCGACGACACCGTGCTGGAGGACATCAACCTGCCCGGCAAGTGGAAGCCCAAG
ATGATCGGCGGCATCGGCGGCTTCATCAAGGTGAAGCAGTACGACAACATCCTGATCGAGATCTGCGGCCACAAGGCCATCGGCACCGTGCTGGTGGGCCC
CACCCCCGTGAACATCATCGGCCGCAACCTGCTGACCCAGCTGGGCTGCACCCTGAACTTCCCCATCTCCCCCATCGAGACCGTGCCCGTGAAGCTGAAGC
CCGGCATGGACGGCCCCAAGGTGAAGCAGTGGCCCCTGACCGAGGAGAAGATCAAGGCCCTGACCGAGATCTGCACCGAGATGGAGAAGGAGGGCAAGATC
TCCAAGATCGGCCCCGAGAACCCCTACAACACCCCCGTGTTCGCCATCAAGAAGAAGGACTCCACCAAGTGGCGCAAGCTGGTGGACTTCCGCGAGCTGAA
CAAGCGCACCCAGGACTTCTGGGAGGTGCAGCTGGGCATCCCCCACCCCGCCGGCCTGAAGAAGAAGAAGTCCGTGACCGTGCTGGACGTGGGCGACGCCT
ACTTCTCCGTGCCCCTGGACAAGGACTTCCGCAAGTACACCGCCTTCACCATCCCCTCCGTGAACAACGAGACCCCCGGCATCCGCTACCAGTACAACGTG
CTGCCCCAGGGCTGGAAGGGCTCCCCCGCCATCTTCCAGTCCTCCATGACCAAGATCCTGGAGCCCTTCCGCAAGCAGAACCCCGACATCGTGATCTACCA
GTACATGGACGACCTGTACGTGGGCTCCGACCTGGAGATCGGCCAGCACCGCACCAAGATCGAGGAGCTGCGCCAGCACCTGCTGCGCTGGGGCTTCACCA
CCCCCGACAAGAAGCACCAGAAGGAGCCCCCCTTCCTGTGGATGGGCTACGAGCTGCACCCCGACAAGTGGACCGTGCAGCCCATCGTGCTGCCCGAGAAG
GACTCCTGGACCGTGAACGACATCCAGAAGCTGGTGGGCAAGCTGAACTGGGCCTCCCAGATCTACCCCGGCATCAAGGTGAAGCAGCTGTGCCGCCTGCT
GCGCGGCACCAAGGCCCTGACCGAGGTGATCCCCCTGACCAAGGAGGCCGAGCTGGAGCTGGCCGAGAACCGCGAGATCCTGAAGGAGCCCGTGCACGGCG
TGTACTACGACCCCTCCAAGGACCTGATCGCCGAGATCCAGAAGCAGGGCCAGGGCCAGTGGACCTACCAGATCTACCAGGAGCCCTTCAAGAACCTGAAG
ACCGGCAAGTACGCCCGCATGCGCGGCGCCCACACCAACGACGTGAAGCAGCTGACCGAGGCCGTGCAGAAGATCACCACCGAGTCCATCGTGATCTGGGG
CAAGACCCCCAAGTTCCGCCTGCCCATCCTGAAGGAGACCTGGGACACCTGGTGGACCGAGTACTGGCAGGCCACCTGGATCCCCGAGTGGGAGTTCGTGA
ACACCCCCCCCCTGGTGAAGCTGTGGTACCAGCTGGAGACCGAGCCCATCGCCGGCGCCGAGACCTTCTACGTGGACGGCGCCTCCAACCGCGAGACCAAG
AAGGGCAAGGCCGGCTACGTGACCGACCGCGGCCGCCAGAAGGCCGTGTCCCTGACCGAGACCACCAACCAGAAGGCCGAGCTGCACGCCATCCAGCTGGC
CCTGCAGGACTCCGGCTCCGAGGTGAACATCGTGACCGACTCCCAGTACGCCCTGGGCATCATCCAGGCCCAGCCCGACAAGTCCGAGTCCGAGCTGGTGA
ACCAGATCATCGAGCAGCTGATCAAGAAGGAGAAGGTGTACCTGTCCTGGGTGCCCGCCCACAAGGGCATCGGCGGCAACGAGCAGGTGGACAAGCTGGTG
TCCGCCGGCATCCGCAAGATCCTGTTCCTGGACGGCATCGACAAGGCCCAGGAGGAGCACGAGAAGTACCACAACAACTGGCGCGCCATGGCCTCCGACTT
CAACCTGCCCCCCGTGGTGGCCAAGGAGATCGTGGCCTCCTGCGACAAGTGCCAGCTGAAGGGCGAGGCCATGCACGGCCAGGTGGACTGCTCCCCCGGCA
TCTGGCAGCTGGACTGCACCCACCTGGAGGGCAAGATCATCCTGGTGGCCGTGCACGTGGCCTCCGGCTACCTGGAGGCCGAGGTGATCCCCGCCGAGACC
GGCCAGGAGACCGCCTACTTCATCCTGAAGCTGGCCGGCCGCTGGCCCGTGAAGACCATCCACACCGACAACGGCCCCAACTTCTCCTCCGCCGCCGTGAA
GGCCGCCTGCTGGTGGGCCGGCATCCAGCAGGAGTTCGGCATCCCCTACAACCCCCAGTCCCAGGGCGTGGTGGAGTCCATGAACAAGGAGCTGAAGAAGA
TCATCCGCCAGGTGCGCGACCAGGCCGAGCACCTGAAGACCGCCGTGCAGATGGCCGTGTTCATCCACAACTTCAAGCGCAAGGGCGGCATCGGCGGCTAC
TCCGCCGGCGAGCGCATCATCGACATCATCTCCACCGACATCCAGACCCGCGAGCTGCAGAAGCAGATCATCAAGATCCAGAACTTCCGCGTGTACTACCG
CGACTCCCGCGACCCCGTGTGGAAGGGCCCCGCCAAGCTGCTGTGGAAGGGCGAGGGCGCCGTGGTGATCCAGGACAACTCCGAGATCAAGGTGGTGCCCC
GCCGCAAGGCCAAGATCATCCGCGACTACGGCAAGCAGATGGCCGGCGACGACTGCGTGGCCGGCCGCCAGGACGAGGACTAA

Fig. 127A

84. 2003_CON_14_BG pol.PEP

FFRENLAFQQGEAREFSPEQARANSPTRRELWVRRGDSPLPEARAEGKGDIPLSLPQITLWQRPLVTVRIGGQLIEALLDTGADDTVLEDIN
LPGKWKPKMIGGIGGFIKVRQYDQILIEICGKKAIGTVLVGPTPINIIGRNMLTQIGCTLNFPISPIETVPVKLKPGMDGPKVKQWPLTEEK
IKALTDICTEMEREGKISKIGPENPYNTPIFAIKKKDSTKWRKLVDFRELNKRTQDFWEVQLGIPHPSGLKKKKSVTVLDVGDAYFSVPLDE
SFRKYTAFTIPSTNNETPGIRYQYNVLPQGWKGSPAIFQSSMTKILEPFRIKNPEIVIYQYMDDLYVGSDLEIGQHRAKIEELRKHLLSWGF
TTPDKKHQKEPPFLWMGYELHPDKWTVQPIQLPDKESWTVNDIQKLVGKLNWASQIYPGIKVKQLCKLLRGAKALTDIVPLTAEAELELAEN
REILKEPVHGVYYEPSKELIAEVQKQGLDQWTYQIYQEPYKNLKTGKYAKRGSAHTNDVKQLTEVVQKIATESIVIWGKTPKFKLPIRKETW
EVWWTEYWQATWIPDWEFVNTPPLVKLWYRLETEPIAGAETYYVDGAANRETKLGKAGYVTDKGKQKIITLTETTNQKAELQAIHIALQDSG
SEVNIVTDSQYALGIIQAQPDRSESEVVNQIIEQLIKKEKVYLSWVPAHKGIGGNEQVDKLVSSGIRKVLFLDGIDKAQEEHEKYHSNWRAM
ASDFNLPPVVAKEIVASCDKCQLKGEAMHGQVDCSPGIWQLDCTHLEGKIILVAVHVASGYIEAEVIPAETGQETAYFILKLAGRWPVKIIH
TDNGSNFTSAAVKAACWWANITQEFGIPYNPQSQGVVESMNKELKKIIGQVRDQAEHLKTAVQMAVFIHNFKRKGGIGGYSAGERIIDIIAS
DIQTKELQKQITKIQNFRVYFRDSRDPIWKGPAKLLWKGEGAVVIQDNNEIKVVPRRKAKIIRDYGKQMAGDDCVAGRQDED$

Fig. 127B

2003_CON_14_BG pol.OPT

TTCTTCCGCGAGAACCTGGCCTTCCAGCAGGGCGAGGCCCGCGAGTTCTCCCCCGAGCAGGCCCGCGCCAACTCCCCCACCCGCCGCGAGCTGTGGGTGCG
CCGCGGCGACTCCCCCCTGCCCGAGGCCCGCGCCGAGGGCAAGGGCGACATCCCCCTGTCCCTGCCCCAGATCACCCTGTGGCAGCGCCCCCTGGTGACCG
TGCGCATCGGCGGCCAGCTGATCGAGGCCCTGCTGGACACCGGCGCCGACGACACCGTGCTGGAGGACATCAACCTGCCCGGCAAGTGGAAGCCCAAGATG
ATCGGCGGCATCGGCGGCTTCATCAAGGTGCGCCAGTACGACCAGATCCTGATCGAGATCTGCGGCAAGAAGGCCATCGGCACCGTGCTGGTGGGCCCCAC
CCCCATCAACATCATCGGCCGCAACATGCTGACCCAGATCGGCTGCACCCTGAACTTCCCCATCTCCCCCATCGAGACCGTGCCCGTGAAGCTGAAGCCCG
GCATGGACGGCCCCAAGGTGAAGCAGTGGCCCCTGACCGAGGAGAAGATCAAGGCCCTGACCGACATCTGCACCGAGATGGAGCGCGAGGGCAAGATCTCC
AAGATCGGCCCCGAGAACCCCTACAACACCCCCATCTTCGCCATCAAGAAGAAGGACTCCACCAAGTGGCGCAAGCTGGTGGACTTCCGCGAGCTGAACAA
GCGCACCCAGGACTTCTGGGAGGTGCAGCTGGGCATCCCCCACCCCTCCGGCCTGAAGAAGAAGAAGTCCGTGACCGTGCTGGACGTGGGCGACGCCTACT
TCTCCGTGCCCCTGGACGAGTCCTTCCGCAAGTACACCGCCTTCACCATCCCCTCCACCAACAACGAGACCCCCGGCATCCGCTACCAGTACAACGTGCTG
CCCCAGGGCTGGAAGGGCTCCCCCGCCATCTTCCAGTCCTCCATGACCAAGATCCTGGAGCCCTTCCGCATCAAGAACCCCGAGATCGTGATCTACCAGTA
CATGGACGACCTGTACGTGGGCTCCGACCTGGAGATCGGCCAGCACCGCGCCAAGATCGAGGAGCTGCGCAAGCACCTGCTGTCCTGGGGCTTCACCACCC
CCGACAAGAAGCACCAGAAGGAGCCCCCCTTCCTGTGGATGGGCTACGAGCTGCACCCCGACAAGTGGACCGTGCAGCCCATCCAGCTGCCCGACAAGGAG
TCCTGGACCGTGAACGACATCCAGAAGCTGGTGGGCAAGCTGAACTGGGCCTCCCAGATCTACCCCGGCATCAAGGTGAAGCAGCTGTGCAAGCTGCTGCG
CGGCGCCAAGGCCCTGACCGACATCGTGCCCCTGACCGCCGAGGCCGAGCTGGAGCTGGCCGAGAACCGCGAGATCCTGAAGGAGCCCGTGCACGGCGTGT
ACTACGAGCCCTCCAAGGAGCTGATCGCCGAGGTGCAGAAGCAGGGCCTGGACCAGTGGACCTACCAGATCTACCAGGAGCCCTACAAGAACCTGAAGACC
GGCAAGTACGCCAAGCGCGGCTCCGCCCACACCAACGACGTGAAGCAGCTGACCGAGGTGGTGCAGAAGATCGCCACCGAGTCCATCGTGATCTGGGGCAA
GACCCCCAAGTTCAAGCTGCCCATCCGCAAGGAGACCTGGGAGGTGTGGTGGACCGAGTACTGGCAGGCCACCTGGATCCCCGACTGGGAGTTCGTGAACA
CCCCCCCCCTGGTGAAGCTGTGGTACCGCCTGGAGACCGAGCCCATCGCCGGCGCCGAGACCTACTACGTGGACGGCGCCGCCAACCGCGAGACCAAGCTG
GGCAAGGCCGGCTACGTGACCGACAAGGGCAAGCAGAAGATCATCACCCTGACCGAGACCACCAACCAGAAGGCCGAGCTGCAGGCCATCCACATCGCCCT
GCAGGACTCCGGCTCCGAGGTGAACATCGTGACCGACTCCCAGTACGCCCTGGGCATCATCCAGGCCCAGCCCGACCGCTCCGAGTCCGAGGTGGTGAACC
AGATCATCGAGCAGCTGATCAAGAAGGAGAAGGTGTACCTGTCCTGGGTGCCCGCCCACAAGGGCATCGGCGGCAACGAGCAGGTGGACAAGCTGGTGTCC
TCCGGCATCCGCAAGGTGCTGTTCCTGGACGGCATCGACAAGGCCCAGGAGGAGCACGAGAAGTACCACTCCAACTGGCGCGCCATGGCCTCCGACTTCAA
CCTGCCCCCCGTGGTGGCCAAGGAGATCGTGGCCTCCTGCGACAAGTGCCAGCTGAAGGGCGAGGCCATGCACGGCCAGGTGGACTGCTCCCCCGGCATCT
GGCAGCTGGACTGCACCCACCTGGAGGGCAAGATCATCCTGGTGGCCGTGCACGTGGCCTCCGGCTACATCGAGGCCGAGGTGATCCCCGCCGAGACCGGC
CAGGAGACCGCCTACTTCATCCTGAAGCTGGCCGGCCGCTGGCCCGTGAAGATCATCCACACCGACAACGGCTCCAACTTCACCTCCGCCGCCGTGAAGGC
CGCCTGCTGGTGGGCCAACATCACCCAGGAGTTCGGCATCCCCTACAACCCCCAGTCCCAGGGCGTGGTGGAGTCCATGAACAAGGAGCTGAAGAAGATCA
TCGGCCAGGTGCGCGACCAGGCCGAGCACCTGAAGACCGCCGTGCAGATGGCCGTGTTCATCCACAACTTCAAGCGCAAGGGCGGCATCGGCGGCTACTCC
GCCGGCGAGCGCATCATCGACATCATCGCCTCCGACATCCAGACCAAGGAGCTGCAGAAGCAGATCACCAAGATCCAGAACTTCCGCGTGTACTTCCGCGA
CTCCCGCGACCCCATCTGGAAGGGCCCCGCCAAGCTGCTGTGGAAGGGCGAGGGCGCCGTGGTGATCCAGGACAACAACGAGATCAAGGTGGTGCCCCGCC
GCAAGGCCAAGATCATCCGCGACTACGGCAAGCAGATGGCCGGCGACGACTGCGTGGCCGGCCGCCAGGACGAGGACTAA

Figure 128

Wildtype Vs. Consensus Env Oligomers as Immunogens

Fig. 128 cont'd

Consensus Envs vs. WT Envs

| Consensus Envs | Wildtype Envs |
|---|---|
| A.Con-2003 gp140CF | A.00KE_MSA4076 gp140CF |
| B.Con-2001 gp140CFI | A.92RW020 gp140CFI |
| B.Con-2003 gp140CF | B.JRFL gp140CF |
| C.Con-2003 gp140CF | B.JRFL-APA mutant gp140CF |
| G.Con-2003 gp140CF | C.97ZA012 (VRC C) gp140CFI |
| AE_01. Con-2003 gp140CF | C.DU123 gp140CF |
| M.CON6-1999 gp140CFI | G.DRCBL gp140CF |
| M.CON6-1999 gp140CF | AE_01.97CNGX2F gp140CF |
| M.CON-S-2001 gp140CFI | |
| M.CON-S-2001 gp140CF | |
| M.CON-T-2003 gp140CF | |

Sequence Comparison of Year 2001 (CON-S) And Year 2003 (CON-T) Group M Consensus Envs

Fig. 128 cont'd

Neutralization Titers Of Guinea Pig Serum Induced With Group M Consensus Env CON-S (Year 2001) and CON-T (Year 2003)

| HIV-1 Isolate | Year 2001 CON-S gp140CFI/oCpG Guinea Pig Number | | | | Year 2003 CON-T gp140CF/oCpG Guinea Pig Number | | | |
|---|---|---|---|---|---|---|---|---|
| (Subtype) | 963 | 964 | 965 | 966 | 1156 | 1162 | 1163 | 1164 |
| B.BX08# | 160 | 211 | 213 | 260 | <20 | <20 | <20 | <20 |
| B.QH0692.42 | 79 | 165 | 111 | 149 | 54 | 42 | 31 | 43 |
| B.SS1196.1 | 916 | 2,760 | 1,471 | 2,822 | 105 | 136 | 99 | 125 |
| B.SF162.LS | 43,740 | 43,740 | 43,740 | 43,740 | 7,426 | 7,079 | 5,166 | 3,917 |
| B. BaL.26 | 354 | 1,021 | 2,056 | 1,161 | 46 | 93 | 74 | 60 |
| 92US715 | 37 | 60 | 116 | 40 | 30 | 34 | 77 | 84 |
| B.JRFL-MC** | <20 | <20 | 40 | <20 | <20 | <20 | <20 | <20 |
| B.6101 | <20 | <20 | <20 | <20 | <20 | <20 | <20 | <20 |
| B.7165 | 29 | 35 | 63 | 37 | 46 | 48 | 62 | 98 |
| QH0515 | <20 | <20 | <20 | <20 | <20 | <20 | 44 | 43 |
| B.3988 | 47 | 59 | 90 | 42 | <20 | <20 | <20 | <20 |
| B.BG1168 | <20 | <20 | <20 | <20 | <20 | <20 | <20 | <20 |
| ARI.29 | 25 | 36 | 42 | <20 | <20 | <20 | 36 | 73 |
| PAVO | 32 | 49 | 75 | <20 | 31 | <20 | 83 | 188 |
| TORNO | <20 | 41 | 50 | <20 | <20 | 25 | 68 | 86 |
| WITO | 68 | 99 | 100 | 52 | <20 | <20 | <20 | <20 |
| C.TV-1.21 | 1,299 | 2,899 | 1,659 | 4,195 | 988 | 430 | 438 | 611 |
| C.DU123 | 152 | 315 | 127 | >540 | 153 | >540 | 54 | 46 |
| C.DU172.17 | 150 | 130 | 141 | 169 | 269 | 121 | 126 | <20 |
| C.DU151.2 | 53 | 45 | 66 | 48 | 79 | 52 | 46 | 58 |
| C.DU156.12 | 35 | 59 | <20 | 61 | <20 | 23 | 29 | 90 |
| C.DU422.01 | 55 | 57 | 81 | 42 | <20 | <20 | <20 | <20 |
| C.97ZA012.29 | <20 | <20 | <20 | <20 | <20 | <20 | <20 | <20 |
| C.96ZM651.2 | 230 | 261 | 156 | 229 | 62 | 80 | 45 | 60 |
| C.92BR025.9 | 3,503 | 6,297 | 3,916 | 5,542 | >540 | 377 | 384 | 496 |
| C.02ZM233M.PB6 | 80 | 150 | 89 | 108 | <20 | <20 | <20 | <20 |
| C.02ZM197M.PB7 | <20 | <20 | <20 | <20 | <20 | <20 | <20 | <20 |
| A.92RW020.05 | 129 | 306 | 180 | 285 | <20 | <20 | <20 | <20 |
| A.92UG037.01 | <20 | <20 | <20 | <20 | <20 | <20 | <20 | <20 |
| A.Q23 | <20 | <20 | <20 | <20 | <20 | <20 | <20 | <20 |
| A.Q168 | <20 | <20 | <20 | <20 | <20 | <20 | <20 | <20 |
| A.Q259 | <20 | <20 | <20 | <20 | <20 | <20 | <20 | <20 |
| A.Q461 | <20 | <20 | <20 | <20 | <20 | <20 | <20 | <20 |
| A.Q769 | <20 | <20 | <20 | <20 | <20 | <20 | <20 | <20 |
| A.Q842 | <20 | <20 | <20 | <20 | <20 | <20 | <20 | <20 |
| A/E.93TH976 | <20 | <20 | <20 | <20 | <20 | <20 | <20 | <20 |
| SVA | <20 | <20 | <20 | <20 | <20 | <20 | <20 | <20 |

Fig. 128 cont'd

Effect of CON-S gp140CFI Oligomer Env Dose on Binding and Neutralizing Antibody Levels

- Compared .1, 1, 100 ug X4 and a boost with 100ug at the 5th immunization.
- oCpGs Type B adjuvant
- 4 GPs per group

Binding Antibodies Induced by Varying Doses of CONS gp140CFI in oCpGs

Fig. 128 cont'd

Comparison Of Immunization Doses Of CON-S 140CFI Env For Induction Of Neutralization Antibodies In Guinea Pigs

| | 0.1ugx4, 100ugx1 | | | | 1ugx4, 100ugx1 | | | | 100ugx5 | | | |
|---|---|---|---|---|---|---|---|---|---|---|---|---|
| | CON-S 140CFI | | | | CON-S 140CFI | | | | CON-S 140CFI | | | |
| HIV-1 Isolate | Guinea Pig Number | | | | Guinea Pig Number | | | | Guinea Pig Number | | | |
| (Subtype) | 1308 | 1309 | 1310 | 1311 | 1312 | 1313 | 1314 | 1315 | 1316 | 1317 | 1318 | 1319 |
| B.MN | 587 | 5,270 | 13,380 | 108 | 10,189 | 4,554 | 6,840 | 43,740 | 3,209 | 4,218 | 709 | 3,423 |
| B.QH0692.42 | <20 | <20 | <20 | <20 | <20 | <20 | <20 | <20 | 20 | <20 | <20 | 26 |
| B.SS1196.1 | 61 | 889 | 523 | 21 | 1,294 | 156 | 497 | 1,687 | 738 | 600 | 232 | 1,794 |
| B.SF162.LS | 128 | 425 | 287 | 290 | 7,244 | 1,050 | 1,269 | 2,258 | 11,184 | 3,796 | 1,413 | 4,987 |
| B.6535 | <20 | <20 | <20 | <20 | 54 | 43 | 87 | 178 | 353 | 90 | 105 | 804 |
| C.SC422661.8 | <20 | <20 | <20 | <20 | <20 | <20 | <20 | <20 | <20 | <20 | <20 | <20 |
| C.DU156.12 | <20 | <20 | <20 | <20 | <20 | <20 | <20 | <20 | <20 | <20 | <20 | <20 |
| CON-S | 29 | <20 | <20 | <20 | <20 | <20 | <20 | <20 | <20 | 28 | 23 | <20 |

David Montefiori, 2006

Fig. 128 cont'd

Comparison of Group M Consensus Envs with Subtype Consensus Envs for Ability to Neutralize Subtype A, B and C Primary Isolate Env Pseudoviruses

Fig. 178 cont'd

Neutralization Titers Of Guinea Pig Serum Induced With Group M Consensus Env CON-S (Year 2001) and CON-T (Year 2003)

| HIV-1 Isolate | Year 2001 CON-S gp140CFI/oCpG | | | | Year 2003 CON-T gp140CF/oCpG | | | |
|---|---|---|---|---|---|---|---|---|
| | Guinea Pig Number | | | | Guinea Pig Number | | | |
| (Subtype) | 963 | 964 | 965 | 966 | 1156 | 1162 | 1163 | 1164 |
| B.BX08# | 160 | 211 | 213 | 260 | <20 | <20 | <20 | <20 |
| B.QH0692.42 | 79 | 165 | 111 | 149 | 54 | 42 | 31 | 43 |
| B.SS1196.1 | 916 | 2,760 | 1,471 | 2,822 | 105 | 136 | 99 | 125 |
| B.SF162.LS | 43,740 | 43,740 | 43,740 | 43,740 | 7,426 | 7,079 | 5,166 | 3,917 |
| B. BaL.26 | 354 | 1,021 | 2,056 | 1,161 | 46 | 93 | 74 | 60 |
| 92US715 | 37 | 60 | 116 | 40 | 30 | 34 | 77 | 84 |
| B.JRFL-MC** | <20 | <20 | 40 | <20 | <20 | <20 | <20 | <20 |
| B.6101 | <20 | <20 | <20 | <20 | <20 | <20 | <20 | <20 |
| B.7165 | 29 | 35 | 63 | 37 | 46 | 48 | 62 | 98 |
| QH0515 | <20 | <20 | <20 | <20 | <20 | <20 | 44 | 43 |
| B.3988 | 47 | 59 | 90 | 42 | <20 | <20 | <20 | <20 |
| B.BG1168 | <20 | <20 | <20 | <20 | <20 | <20 | <20 | <20 |
| ARI.29 | 25 | 36 | 42 | <20 | <20 | <20 | 36 | 73 |
| PAVO | 32 | 49 | 75 | <20 | 31 | <20 | 83 | 188 |
| TORNO | <20 | 41 | 50 | <20 | <20 | 25 | 68 | 86 |
| WITO | 68 | 99 | 100 | 52 | <20 | <20 | <20 | <20 |
| C.TV-1.21 | 1,299 | 2,899 | 1,659 | 4,195 | 988 | 430 | 438 | 611 |
| C.DU123 | 152 | 315 | 127 | >540 | 153 | >540 | 54 | 46 |
| C.DU172.17 | 150 | 130 | 141 | 169 | 269 | 121 | 126 | <20 |
| C.DU151.2 | 53 | 45 | 66 | 48 | 79 | 52 | 46 | 58 |
| C.DU156.12 | 35 | 59 | <20 | 61 | <20 | 23 | 29 | 90 |
| C.DU422.01 | 55 | 57 | 81 | 42 | <20 | <20 | <20 | <20 |
| C.97ZA012.29 | <20 | <20 | <20 | <20 | <20 | <20 | <20 | <20 |
| C.96ZM651.2 | 230 | 261 | 156 | 229 | 62 | 80 | 45 | 60 |
| C.92BR025.9 | 3,503 | 6,297 | 3,916 | 5,542 | >540 | 377 | 384 | 496 |
| C.02ZM233M.PB6 | 80 | 150 | 89 | 108 | <20 | <20 | <20 | <20 |
| C.02ZM197M.PB7 | <20 | <20 | <20 | <20 | <20 | <20 | <20 | <20 |
| A.92RW020.05 | 129 | 306 | 180 | 285 | <20 | <20 | <20 | <20 |
| A.92UG037.01 | <20 | <20 | <20 | <20 | <20 | <20 | <20 | <20 |
| A.Q23 | <20 | <20 | <20 | <20 | <20 | <20 | <20 | <20 |
| A.Q168 | <20 | <20 | <20 | <20 | <20 | <20 | <20 | <20 |
| A.Q259 | <20 | <20 | <20 | <20 | <20 | <20 | <20 | <20 |
| A.Q461 | <20 | <20 | <20 | <20 | <20 | <20 | <20 | <20 |
| A.Q769 | <20 | <20 | <20 | <20 | <20 | <20 | <20 | <20 |
| A.Q842 | <20 | <20 | <20 | <20 | <20 | <20 | <20 | <20 |
| A/E.93TH976 | <20 | <20 | <20 | <20 | <20 | <20 | <20 | <20 |
| SVA | <20 | <20 | <20 | <20 | <20 | <20 | <20 | <20 |

Fig. 128 cont'd

Neutralization Titers Of Guinea Pig Sera Induced With Subtype Consensus Envelope Oligomers

| HIV-1 Isolate | 2003 A.con env-03 140CF | | | | 2001 B.con 140CFI | | | | 2003 C.con env-03 140CF | | | | 2003 G.con env-03 140CF | | | | 2003 G.con env-03 140CF | | | |
|---|---|---|---|---|---|---|---|---|---|---|---|---|---|---|---|---|---|---|---|---|
| | Guinea Pig Number | | | | Guinea Pig Number | | | | Guinea Pig Number | | | | Guinea Pig Number | | | | Guinea Pig Number | | | |
| (Subtype) | 1300 | 1301 | 1302 | 1303 | 980 | 1132 | 1098 | 1099 | 1268 | 1269 | 1270 | 1271 | 1353 | 1354 | 1355 | 1356 | 1501 | 1502 | 1503 | 1504 |
| B.BX08# | 160 | 176 | 128 | 137 | 66 | <20 | <20 | <20 | <20 | <20 | <20 | <20 | | | | | | | | |
| B.QH0692.42 | 129 | 157 | 185 | 135 | 44 | 46 | 49 | 53 | 149 | 138 | 76 | 110 | 37 | 45 | 39 | <20 | | | | |
| B.SS1196.1 | 130 | 449 | 291 | 141 | 1,257 | 717 | 922 | 881 | 402 | >540 | 253 | 484 | 2,973 | 1,094 | 260 | 5,265 | | | | |
| B.SF162.LS | 8,686 | 20,502 | 12,427 | 9,920 | 11,030 | 6,194 | 5,608 | 15,012 | 37,634 | 41,842 | 16,225 | 16,511 | 60,378 | 21,003 | 10,610 | 15,347 | | | | |
| B. BaL.26 | 86 | >540 | 152 | 112 | 364 | 164 | 362 | 304 | 356 | 293 | 134 | 233 | 179 | 126 | 31 | 67 | | | | |
| B.92US715 | 30 | 77 | 38 | 27 | 126 | 69 | 184 | 177 | <20 | 60 | <20 | 34 | 36 | 44 | 41 | <20 | | | | |
| B.JRFL-MC** | 24 | 42 | 28 | <20 | 35 | 36 | <20 | <20 | 43 | 45 | <20 | <20 | <20 | <20 | <20 | <20 | | | | |
| B. 6101 | <20 | <20 | <20 | <20 | <20 | <20 | <20 | <20 | <20 | <20 | 23 | 29 | <20 | <20 | <20 | <20 | | | | |
| B.7165 | 32 | 67 | 43 | 21 | 83 | 59 | 134 | 112 | 28 | 40 | <20 | <20 | <20 | <20 | <20 | <20 | | | | |
| QH0515 | <20 | <20 | <20 | <20 | <20 | 24 | 40 | 25 | <20 | <20 | <20 | <20 | <20 | 34 | <20 | <20 | | | | |
| B.BG1168 | <20 | 40 | <20 | <20 | <20 | <20 | 24 | 23 | <20 | <20 | <20 | <20 | <20 | <20 | <20 | <20 | | | | |
| B.3988 | <20 | <20 | <20 | <20 | <20 | <20 | <20 | <20 | <20 | <20 | <20 | <20 | 31 | 29 | 37 | <20 | | | | |
| ARI.29 | <20 | <20 | <20 | <20 | 23 | <20 | 69 | 49 | <20 | <20 | <20 | <20 | | | | | | | | |
| PAVO | 44 | 41 | 26 | 42 | 51 | 27 | 90 | 72 | <20 | <20 | <20 | <20 | <20 | <20 | <20 | <20 | | | | |
| TORNO | 25 | 32 | 22 | 22 | 55 | 28 | <20 | <20 | <20 | <20 | <20 | <20 | | | | | | | | |
| WITO | <20 | <20 | <20 | <20 | <20 | <20 | <20 | <20 | 30 | 65 | <20 | <20 | 81 | 56 | 50 | 33 | | | | |
| C.TV-1.21 | 720 | 1224 | 1046 | 751 | <20 | <20 | <20 | <20 | 2,029 | 2,547 | 1,939 | 1,699 | 3,035 | 791 | 466 | 440 | | | | |
| C.DU123 | 99 | 127 | 86 | 173 | <20 | <20 | <20 | <20 | 107 | 150 | 108 | 136 | 359 | 102 | 104 | 105 | | | | |
| C.DU172.18 | 241 | 237 | 389 | 251 | <20 | <20 | <20 | <20 | 70 | 121 | 128 | 152 | | | | | | | | |
| C.DU151 | 69 | 78 | 64 | 62 | <20 | <20 | <20 | <20 | 33 | 50 | 64 | <20 | 38 | 28 | 23 | <20 | | | | |
| C.DU156 | 97 | 89 | 105 | 69 | <20 | <20 | <20 | <20 | 34 | 85 | 85 | 78 | 264 | 55 | 44 | 59 | | | | |
| C.DU422 | 63 | 43 | <20 | <20 | <20 | <20 | <20 | <20 | 32 | 51 | 40 | 46 | 265 | 48 | 192 | 38 | | | | |
| C.97ZA012 | 27 | 31 | 30 | 23 | <20 | <20 | <20 | <20 | <20 | <20 | <20 | <20 | <20 | <20 | <20 | <20 | | | | |
| C.96ZM651.2 | <20 | 55 | 59 | <20 | 34 | 33 | 36 | 30 | <20 | 149 | <20 | <20 | 50 | 38 | 57 | 94 | | | | |
| C.92BR025 | 210 | 995 | 985 | 594 | 32 | 42 | 76 | 75 | 276 | 546 | 908 | 578 | | | | | | | | |
| C.02ZM233M.PB6 | 112 | 119 | 108 | 113 | <20 | <20 | 24 | 21 | 49 | 100 | 87 | 96 | | | | | | | | |
| C.02ZM197M.PB7 | 78 | 58 | <20 | 66 | <20 | 23 | 29 | 26 | 27 | 64 | 21 | <20 | | | | | | | | |
| A.92RW020.05 | 57 | 169 | 134 | 137 | 26 | 27 | <20 | <20 | 168 | 229 | 98 | 170 | 489 | 116 | 131 | 231 | | | | |
| A.92UG037.01 | <20 | 25 | <20 | <20 | 20 | 23 | 23 | 27 | <20 | 26 | 25 | <20 | | | | | | | | |
| A. Q23 | <20 | <20 | 21 | <20 | <20 | <20 | <20 | <20 | <20 | <20 | <20 | <20 | <20 | 25 | 32 | <20 | | | | |
| A.Q168 | <20 | 24 | <20 | <20 | <20 | <20 | <20 | <20 | <20 | <20 | <20 | <20 | 26 | 22 | <20 | <20 | | | | |
| A.Q259 | <20 | <20 | <20 | <20 | <20 | <20 | <20 | <20 | <20 | <20 | <20 | <20 | | | | | | | | |
| A.Q461 | <20 | 28 | <20 | <20 | <20 | <20 | <20 | <20 | <20 | <20 | <20 | <20 | 28 | 27 | 46 | <20 | | | | |
| A.Q769 | <20 | <20 | <20 | <20 | <20 | <20 | <20 | <20 | <20 | <20 | <20 | <20 | | | | | | | | |
| A.Q842 | <20 | <20 | <20 | <20 | <20 | <20 | <20 | <20 | <20 | <20 | <20 | <20 | | | | | | | | |
| A/E.93TH976 | <20 | 21 | <20 | <20 | <20 | 27 | <20 | <20 | <20 | <20 | <20 | <20 | 52 | 60 | 86 | 27 | | | | |

Fig. 128 cont'd

Can We Use the Phenomenon of "Original Antigenic Sin" to Direct Immune Responses To Conserved Envelope Determinants?

Fig. 128 cont'd

Original Antigenic Sin

- Priming immunization with Env #1 induces immune responses to immunodominant epitopes of Env #1.
- Boost with Env #2 boosts immune responses of epitopes on Env #1 in preference to epitopes on Env #2.
- An experimental question is whether immunizing with Env #1, #2, #3 would preferentially boost antibody responses that are common to Env #1, #2, #3, and not boost antibody responses to epitopes that are disparate among the Envs.

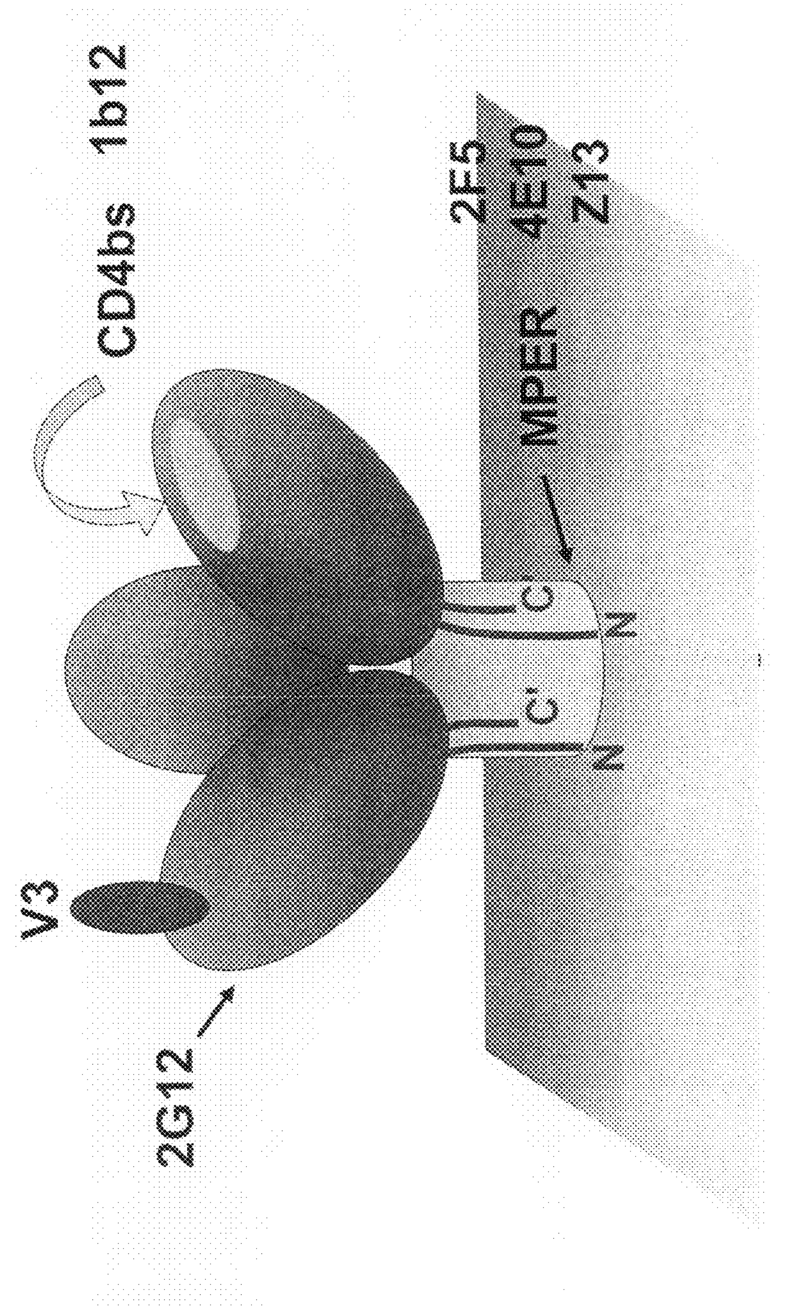
HIV-1 Trimeric Envelope

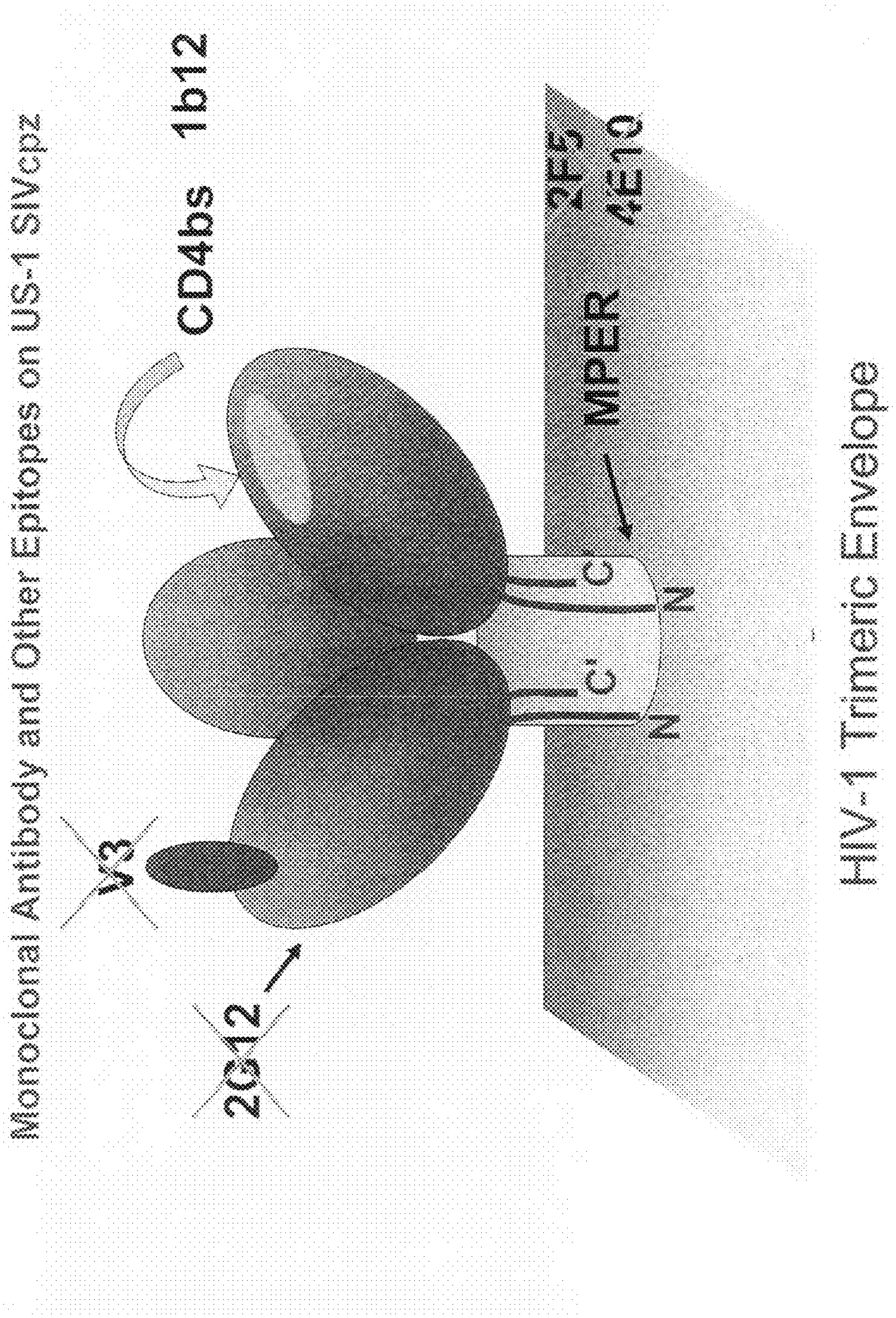
Monoclonal Antibody and Other Epitopes on US-1 SIVcpz
2G12
V3
CD4bs 1b12
C'
C
N
N
MPER
2F5
4E10
HIV-1 Trimeric Envelope

Fig. 128 cont'd

Neutralization Titers Of Guinea Pig Primed and Boost With Different Immunogens Expressing CD4 Binding Site or 2F5 Binding Sites

| HIV-1 Isolate | CON-S x1, US-1 x3 | | | |
|---|---|---|---|---|
| | Guinea Pig Number | | | |
| (Subtype) | 1324 | 1325 | 1326 | 1327 |
| B.BX08# | | | | |
| B.QH0692.42 | 33 | 57 | 61 | 54 |
| B.SS1196.1 | <20 | 27 | 44 | 48 |
| B.SF162.LS | 55 | 127 | 295 | 240 |
| B. BaL.26 | 26 | 38 | 50 | 38 |
| 92US715 | | | | |
| B.JRFL-MC** | | | | |
| B.6101 | | | | |
| B.6535 | <20 | <20 | 22 | <20 |
| B.3988 | | | | |
| B.BG1168 | <20 | <20 | <20 | <20 |
| ARI.29 | | | | |
| PAVO | <20 | 21 | 25 | <20 |
| TORNO | | | | |
| WITO | | | | |
| C.TV-1.21 | 37 | 54 | 78 | 78 |
| C.DU123 | 82 | 112 | 126 | 79 |

Fig. 128 cont'd

Neutralization Titers Of Guinea Pig Primed and Boost With Different Immunogens Expressing CD4 Binding Site or 2F5 Binding Sites

| | CON-S x1, US-1 x3 | | | | US-1 x1, CON-S x3 | | |
|---|---|---|---|---|---|---|---|
| HIV-1 Isolate | Guinea Pig Number | | | | Guinea Pig Number | | |
| (Subtype) | 1324 | 1325 | 1326 | 1327 | 1328 | 1329 | 1331 |
| B.BX08# | | | | | | | |
| B.QH0692.42 | 33 | 57 | 61 | 54 | 75 | 67 | 68 |
| B.SS1196.1 | <20 | 27 | 44 | 48 | 134 | 231 | 260 |
| B.SF162.LS | 55 | 127 | 295 | 240 | >540 | >540 | >540 |
| B. BaL.26 | 26 | 38 | 50 | 38 | 145 | 104 | 141 |
| 92US715 | | | | | | | |
| B.JRFL-MC** | | | | | | | |
| B.6101 | | | | | | | |
| B.6535 | <20 | <20 | 22 | <20 | 40 | 177 | 121 |
| B.3988 | | | | | | | |
| B.BG1168 | <20 | <20 | <20 | <20 | <20 | <20 | <20 |
| ARI.29 | | | | | | | |
| PAVO | <20 | 21 | 25 | <20 | <20 | <20 | <20 |
| TORNO | | | | | | | |
| WITO | | | | | | | |
| C.TV-1.21 | 37 | 54 | 78 | 78 | 472 | 393 | 297 |
| C.DU123 | 82 | 112 | 126 | 79 | 108 | 130 | 113 |

Fig. 128 cont'd

Neutralization Titers Of Guinea Pig Primed and Boost With Different Immunogens Expressing CD4 Binding Site or 2F5 Binding Sites

| | CON-S x1, US-1 x3 | | | | US-1 x1, CON-S x3 | | | US-1 x1, CON-S x1, JRFL x1 | | | |
|---|---|---|---|---|---|---|---|---|---|---|---|
| HIV-1 Isolate | Guinea Pig Number | | | | Guinea Pig Number | | | Guinea Pig Number | | | |
| (Subtype) | 1324 | 1325 | 1326 | 1327 | 1328 | 1329 | 1331 | 1332 | 1333 | 1334 | 1335 |
| B.BX08# | | | | | | | | | | | |
| B.QH0692.42 | 33 | 57 | 61 | 54 | 75 | 67 | 68 | 49 | 42 | 43 | 58 |
| B.SS1196.1 | <20 | 27 | 44 | 48 | 134 | 231 | 260 | 95 | 115 | 78 | 120 |
| B.SF162.LS | 55 | 127 | 295 | 240 | >540 | >540 | >540 | >540 | >540 | >540 | >540 |
| B. BaL.26 | 26 | 38 | 50 | 38 | 145 | 104 | 141 | 77 | 84 | 59 | 129 |
| 92US715 | | | | | | | | | | | |
| B.JRFL-MC** | | | | | | | | | | | |
| B.6101 | | | | | | | | | | | |
| B.6535 | <20 | <20 | 22 | <20 | 40 | 177 | 121 | <20 | 30 | <20 | 31 |
| B.3988 | | | | | | | | | | | |
| B.BG1168 | <20 | <20 | <20 | <20 | <20 | <20 | <20 | <20 | <20 | 23 | <20 |
| ARI.29 | | | | | | | | | | | |
| PAVO | <20 | 21 | 25 | <20 | <20 | <20 | <20 | <20 | <20 | 53 | 21 |
| TORNO | | | | | | | | | | | |
| WITO | | | | | | | | | | | |
| C.TV-1.21 | 37 | 54 | 78 | 78 | 472 | 393 | 297 | 131 | 114 | 117 | 242 |
| C.DU123 | 82 | 112 | 126 | 79 | 108 | 130 | 113 | 104 | 109 | 118 | 72 |

Fig. 128 cont'd

Neutralization Titers Of Guinea Pig Primed and Boost With Different Immunogens Expressing CD4 Binding Site or 2F5 Binding Sites

| | CON-S x1, US-1 x3 | | | | US-1 x1, CON-S x3 | | | US-1 x1, CON-S x1, JRFL x1 | | | | CON-S x1. US-1 x1, JRFL x1 | | |
|---|---|---|---|---|---|---|---|---|---|---|---|---|---|---|
| HIV-1 Isolate | Guinea Pig Number | | | | Guinea Pig Number | | | Guinea Pig Number | | | | Guinea Pig Number | | |
| (Subtype) | 1324 | 1325 | 1326 | 1327 | 1328 | 1329 | 1331 | 1332 | 1333 | 1334 | 1335 | 1336 | 1338 | 1340 |
| B.BX08# | | | | | | | | | | | | | | |
| B.QH0692.42 | 33 | 57 | 61 | 54 | 75 | 67 | 68 | 49 | 42 | 43 | 58 | 88 | 74 | 75 |
| B.SS1196.1 | <20 | 27 | 44 | 48 | 134 | 231 | 260 | 95 | 115 | 78 | 120 | 265 | 405 | 205 |
| B.SF162.LS | 55 | 127 | 295 | 240 | >540 | >540 | >540 | >540 | >540 | >540 | >540 | >540 | >540 | >540 |
| B. BaL.26 | 26 | 38 | 50 | 38 | 145 | 104 | 141 | 77 | 84 | 59 | 129 | 224 | 381 | 280 |
| 92US715 | | | | | | | | | | | | <20 | <20 | <20 |
| B.JRFL-MC** | | | | | | | | | | | | <20 | <20 | <20 |
| B.6101 | | | | | | | | | | | | <20 | <20 | <20 |
| B.6535 | <20 | <20 | 22 | <20 | 40 | 177 | 121 | <20 | 30 | <20 | 31 | 88 | 105 | 96 |
| B.3988 | | | | | | | | | | | | 41 | <20 | 21 |
| B.BG1168 | <20 | <20 | <20 | <20 | <20 | <20 | <20 | <20 | <20 | 23 | <20 | <20 | <20 | <20 |
| ARI.29 | | | | | | | | | | | | | | |
| PAVO | <20 | 21 | 25 | <20 | <20 | <20 | <20 | <20 | <20 | 53 | 21 | <20 | <20 | <20 |
| TORNO | | | | | | | | | | | | | | |
| WITO | | | | | | | | | | | | <20 | <20 | <20 |
| C.TV-1.21 | 37 | 54 | 78 | 78 | 472 | 393 | 297 | 131 | 114 | 117 | 242 | 360 | >540 | 378 |
| C.DU123 | 82 | 112 | 126 | 79 | 108 | 130 | 113 | 104 | 109 | 118 | 72 | 115 | 85 | 50 |

Fig. 128 cont'd

Is One Component of Poor Env Immunogenicity Related To Immunosuppressive Effects of CD4 Binding by gp120?

Fig. 128 cont'd

Negative Effects of gp120 As An Immunogen

- Binding to T and monocyte/macrophage CD4 and downmodulating specific antigen specific responses (Mol. Immunol. 44: 2124, 2007; Clin. Exp. Immunol. 131: 422, 2003; many others)
- Non-CD4 dependent immunosuppression (J. Leukocyte Biol. 74: 1117, 2003; Blood 109: 3351, 2007, many others)
- Binding to B cell C-type lectin receptors and inducing polyclonal Ig switching (J. Immunol. 176: 3931, 2006)
- Gp120 inhibition of TLR-9 activation and IFN-$\alpha$ secretion in plasmacytoid DCs (PNAS 104: 3396, 2007)

HIV-1 JRFL Wild-type Env And Mutant Env With Mutation At CD4 Binding Site

HIV-1 Trimeric Envelope

Comparison Of HIV-1 JRFL Env And JRFL CD4BS Mutant Env For Binding Of sCD4

Fig. 128 cont'd

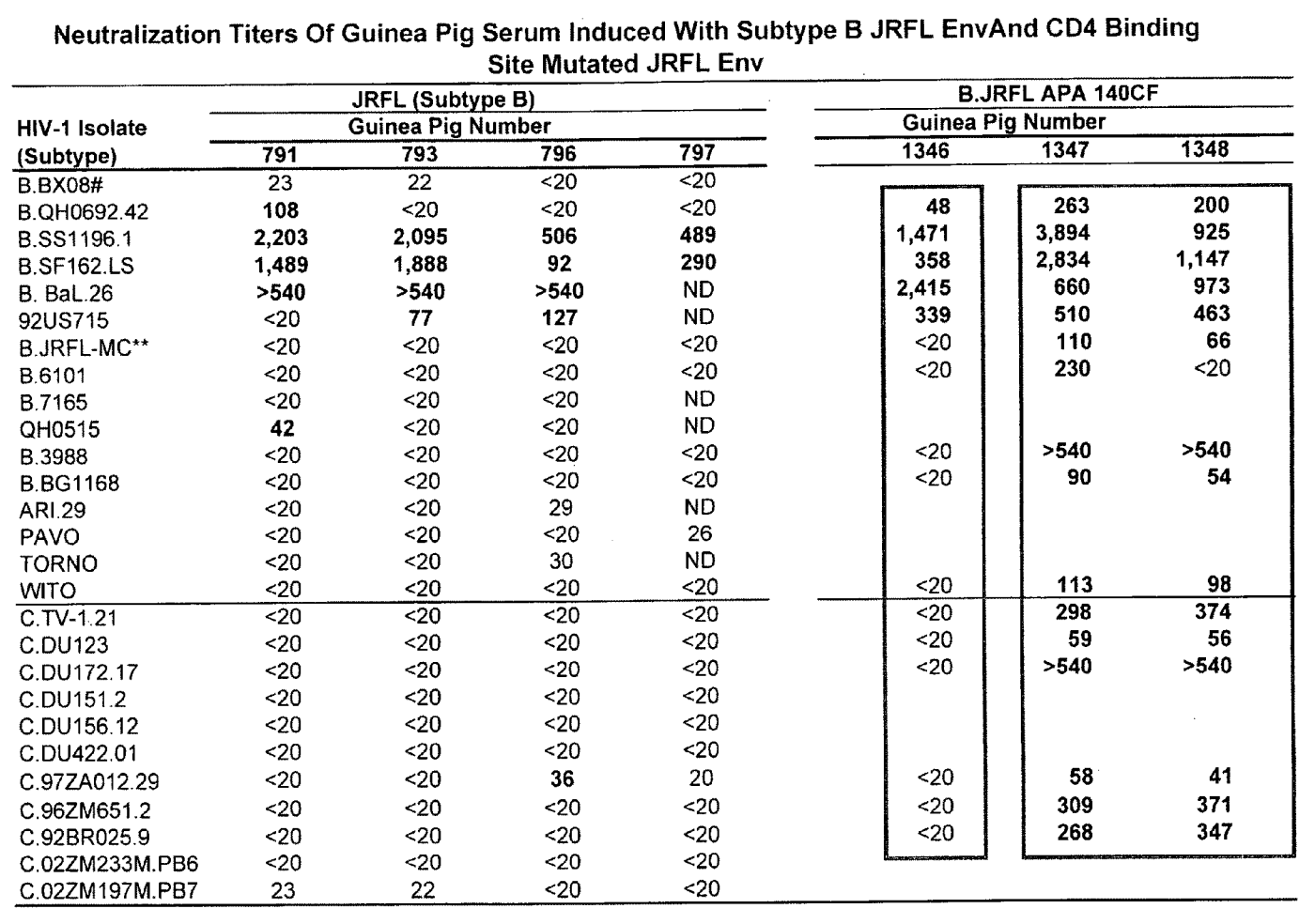

Neutralization Titers Of Guinea Pig Serum Induced With Subtype B JRFL EnvAnd CD4 Binding Site Mutated JRFL Env

| HIV-1 Isolate | JRFL (Subtype B) | | | | B.JRFL APA 140CF | | |
|---|---|---|---|---|---|---|---|
| | Guinea Pig Number | | | | Guinea Pig Number | | |
| (Subtype) | 791 | 793 | 796 | 797 | 1346 | 1347 | 1348 |
| B.BX08# | 23 | 22 | <20 | <20 | | | |
| B.QH0692.42 | **108** | <20 | <20 | <20 | **48** | **263** | **200** |
| B.SS1196.1 | **2,203** | **2,095** | **506** | **489** | **1,471** | **3,894** | **925** |
| B.SF162.LS | **1,489** | **1,888** | **92** | **290** | **358** | **2,834** | **1,147** |
| B. BaL.26 | **>540** | **>540** | **>540** | ND | **2,415** | **660** | **973** |
| 92US715 | <20 | **77** | **127** | ND | **339** | **510** | **463** |
| B.JRFL-MC** | <20 | <20 | <20 | <20 | <20 | **110** | **66** |
| B.6101 | <20 | <20 | <20 | <20 | <20 | **230** | <20 |
| B.7165 | <20 | <20 | <20 | ND | | | |
| QH0515 | **42** | <20 | <20 | ND | | | |
| B.3988 | <20 | <20 | <20 | <20 | <20 | **>540** | **>540** |
| B.BG1168 | <20 | <20 | <20 | <20 | <20 | **90** | **54** |
| ARI.29 | <20 | <20 | 29 | ND | | | |
| PAVO | <20 | <20 | <20 | 26 | | | |
| TORNO | <20 | <20 | 30 | ND | | | |
| WITO | <20 | <20 | <20 | <20 | <20 | **113** | **98** |
| C.TV-1.21 | <20 | <20 | <20 | <20 | <20 | **298** | **374** |
| C.DU123 | <20 | <20 | <20 | <20 | <20 | **59** | **56** |
| C.DU172.17 | <20 | <20 | <20 | <20 | <20 | **>540** | **>540** |
| C.DU151.2 | <20 | <20 | <20 | <20 | | | |
| C.DU156.12 | <20 | <20 | <20 | <20 | | | |
| C.DU422.01 | <20 | <20 | <20 | <20 | | | |
| C.97ZA012.29 | <20 | <20 | **36** | 20 | <20 | **58** | **41** |
| C.96ZM651.2 | <20 | <20 | <20 | <20 | <20 | **309** | **371** |
| C.92BR025.9 | <20 | <20 | <20 | <20 | <20 | **268** | **347** |
| C.02ZM233M.PB6 | <20 | <20 | <20 | <20 | | | |
| C.02ZM197M.PB7 | 23 | 22 | <20 | <20 | | | |

Inhibition Of Soluble CD4 Binding By Serum Of Guinea Pigs Immunized With HIV-1 Envelope Proteins
% Inhibition of sCD4 Binding to HIV-1 Env
100
80
60
40
20
0
Assayed on B.JRFL Env
Assayed on C.97ZA012 Env
A.92RW020
B.JRFL
C.97ZA012
CON-S
HIV-1 Envelope gp140 Immunogens Inhibition Of Biotinylated 1b12 Binding To B.JRFL Env By Serum Of Guinea Pigs Immunized With HIV-1 Envelope Proteins
% Inhibition of sCD4 bing to B.JRFL
100
80
60
40
20
0
A.92RW020
B.JRFL
C.97ZA012
CON-S
Guinea Pig Immune Sera

Fig 128 cont'd

Can the JRFL mutant Env that does not bind CD4 induce anti-carbohydrate Env antibodies?

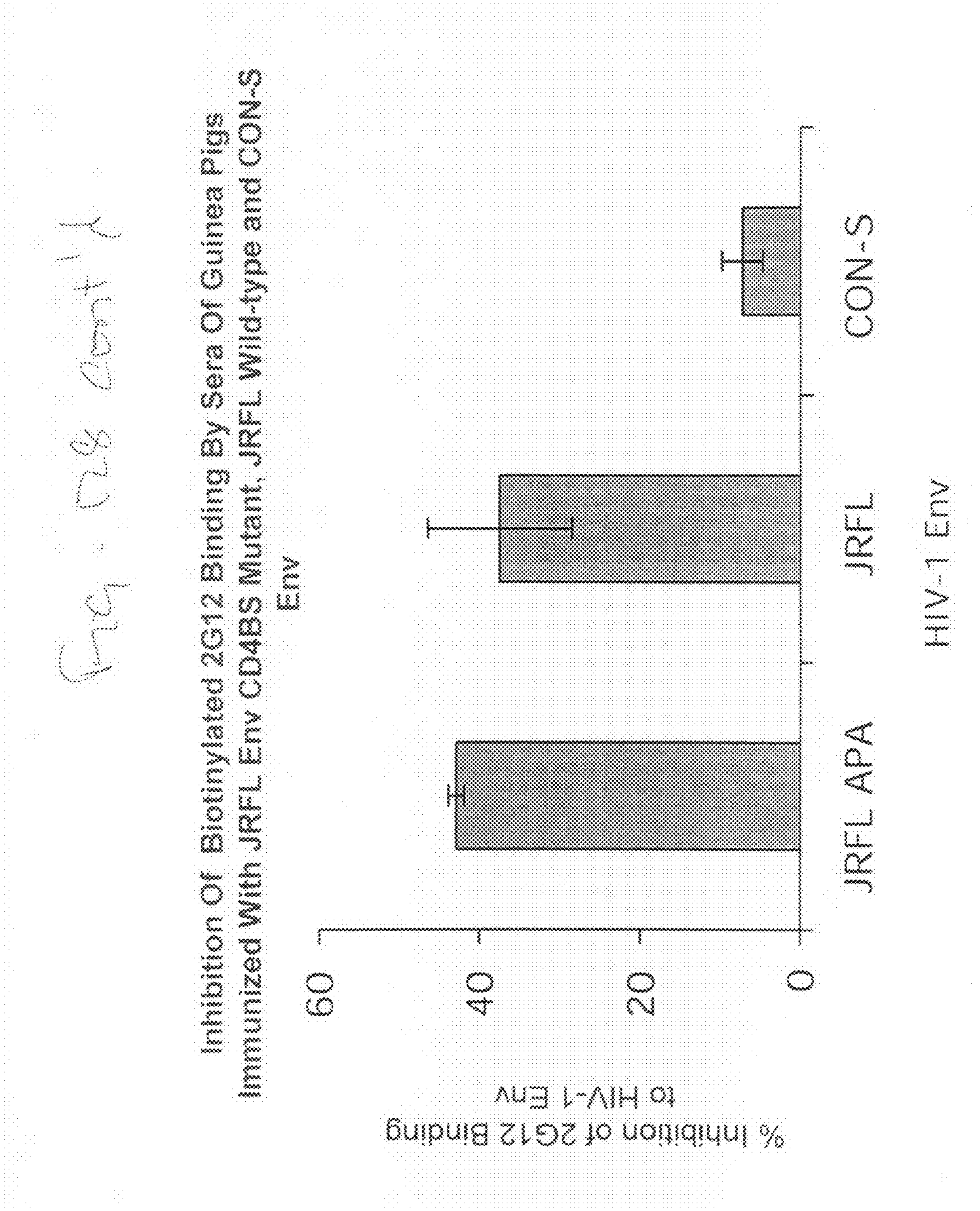
Inhibition Of Biotinylated 2G12 Binding By Sera Of Guinea Pigs Immunized With JRFL Env CD4BS Mutant, JRFL Wild-type and CON-S Env
% Inhibition of 2G12 Binding to HIV-1 Env
60
40
20
0
JRFL APA
JRFL
CON-S
HIV-1 Env

Fig. 128 cont'd

Can any of the new WT HIV-1 Envs induce antibodies with breadth equivalent to the consensus Envs?

Fig. 128 cont'd

Consensus Envs vs. WT Envs

| Consensus Envs | Wildtype Envs |
|---|---|
| A.Con-2003 gp140CF | A.00KE_MSA4076 gp140CF |
| B.Con-2001 gp140CFI | A.92RW020 gp140CFI |
| B.Con-2003 gp140CF | B.JRFL gp140CF |
| C.Con-2003 gp140CF | B.JRFL-APA mutant gp140CF |
| G.Con-2003 gp140CF | C.97ZA012 (VRC C) gp140CFI |
| AE_01. Con-2003 gp140CF | C.DU123 gp140CF ← AHI Env |
| M.CON6-1999 gp140CFI | G.DRCBL gp140CF |
| M.CON6-1999 gp140CF | AE_01.97CNGX2F gp140CF |
| M.CON-S-2001 gp140CFI | |
| M.CON-S-2001 gp140CF | |
| M.CON-T-2003 gp140CF | |

Fig. 128 cont'd

Neutralization Titers Of Guinea Pig Serum Induced With Wild-type Envelope Oligomers

| HIV-1 Isolate | A.92RW020 140CFI (Subtype A) | | | | B.JRFL 140CF (Subtype B) | | | | C.97ZA012 140CFI (Subtype C) | | | |
|---|---|---|---|---|---|---|---|---|---|---|---|---|
| | Guinea Pig Number | | | | Guinea Pig Number | | | | Guinea Pig Number | | | |
| (Subtype) | 854 | 855 | 856 | 857 | 791 | 793 | 796 | 797 | 862 | 863 | 864 | 865 |
| B.BX08# | <20 | <20 | <20 | <20 | 23 | 22 | <20 | <20 | <20 | <20 | <20 | <20 |
| B.QH0692.42 | **34** | <20 | <20 | **36** | **108** | <20 | <20 | <20 | <20 | <20 | <20 | <20 |
| B.SS1196.1 | **115** | **83** | **100** | **150** | **2,203** | **2,095** | **506** | **489** | 23 | 27 | <20 | <20 |
| B.SF162.LS | **1,546** | **412** | **1,301** | **984** | **1,489** | **1,888** | **92** | **290** | **128** | **421** | **88** | **106** |
| B. BaL.26 | **60** | **38** | **91** | **41** | **>540** | **>540** | **>540** | ND | 24 | **32** | 20 | 20 |
| 92US715 | 24 | <20 | 23 | 21 | <20 | **77** | **127** | ND | <20 | <20 | <20 | <20 |
| B.JRFL-MC** | <20 | <20 | <20 | <20 | <20 | <20 | <20 | <20 | <20 | <20 | <20 | <20 |
| B.6101 | <20 | <20 | <20 | <20 | <20 | <20 | <20 | <20 | <20 | <20 | <20 | <20 |
| B.7165 | **44** | **37** | **45** | **46** | <20 | <20 | <20 | ND | <20 | <20 | <20 | <20 |
| QH0515 | 26 | 24 | 25 | <20 | **42** | <20 | <20 | ND | <20 | 22 | 20 | 32 |
| B.3988 | <20 | <20 | <20 | <20 | <20 | <20 | <20 | <20 | <20 | <20 | <20 | <20 |
| B.BG1168 | <20 | <20 | <20 | <20 | <20 | <20 | <20 | <20 | <20 | <20 | <20 | <20 |
| ARI.29 | <20 | <20 | <20 | <20 | <20 | <20 | 29 | ND | <20 | <20 | <20 | <20 |
| PAVO | <20 | 21 | 20 | <20 | <20 | <20 | <20 | 26 | <20 | <20 | <20 | <20 |
| TORNO | 27 | 21 | 27 | <20 | <20 | <20 | 30 | ND | 24 | <20 | <20 | <20 |
| WITO | <20 | <20 | <20 | <20 | <20 | <20 | <20 | <20 | <20 | 35 | <20 | <20 |
| C.TV-1.21 | **540** | **443** | **449** | **711** | <20 | <20 | <20 | <20 | **93** | **148** | <20 | <20 |
| C.DU123 | **41** | <20 | **48** | **37** | <20 | <20 | <20 | <20 | <20 | **115** | <20 | <20 |
| C.DU172.17 | <20 | <20 | <20 | <20 | <20 | <20 | <20 | <20 | <20 | <20 | <20 | <20 |
| C.DU151.2 | <20 | <20 | <20 | <20 | <20 | <20 | <20 | <20 | <20 | <20 | <20 | <20 |
| C.DU156.12 | <20 | <20 | <20 | <20 | <20 | <20 | <20 | <20 | <20 | <20 | <20 | <20 |
| C.DU422.01 | <20 | <20 | <20 | <20 | <20 | <20 | <20 | <20 | <20 | <20 | <20 | <20 |
| C.97ZA012.29 | <20 | <20 | <20 | <20 | <20 | <20 | **36** | 20 | <20 | <20 | <20 | <20 |
| C.96ZM651.2 | <20 | <20 | <20 | <20 | <20 | <20 | <20 | <20 | <20 | <20 | <20 | <20 |
| C.92BR025.9 | **403** | **168** | **258** | **311** | <20 | <20 | <20 | <20 | **55** | **50** | <20 | **39** |
| C.02ZM233M.PB6 | <20 | <20 | <20 | <20 | <20 | <20 | <20 | <20 | <20 | <20 | <20 | <20 |
| C.02ZM197M.PB7 | <20 | <20 | <20 | 27 | 23 | 22 | <20 | <20 | 21 | 22 | <20 | <20 |
| A.92RW020.05 | **150** | **71** | **100** | **106** | <20 | <20 | <20 | <20 | <20 | <20 | <20 | <20 |
| A.92UG037.01 | <20 | <20 | <20 | <20 | <20 | <20 | <20 | <20 | <20 | <20 | <20 | <20 |
| A.Q23 | <20 | <20 | <20 | <20 | <20 | <20 | <20 | <20 | <20 | <20 | <20 | <20 |
| A.Q168 | <20 | <20 | <20 | <20 | <20 | <20 | <20 | <20 | <20 | <20 | <20 | <20 |
| A.Q259 | <20 | <20 | <20 | <20 | <20 | <20 | <20 | <20 | <20 | <20 | <20 | <20 |
| A.Q461 | <20 | <20 | <20 | <20 | <20 | <20 | <20 | <20 | <20 | <20 | <20 | <20 |
| A.Q769 | <20 | <20 | <20 | <20 | <20 | <20 | <20 | <20 | <20 | <20 | <20 | <20 |
| A.Q842 | <20 | <20 | <20 | <20 | <20 | <20 | <20 | <20 | <20 | <20 | <20 | <20 |
| A/E.93TH976 | <20 | <20 | <20 | <20 | <20 | <20 | <20 | <20 | <20 | <20 | <20 | <20 |

Fig. 128 cont'd

Neutralization Titers Of Guinea Pig Serum Induced With Wild-type Envelope Oligomers

| HIV-1 Isolate | A.92RW020 140CFI (Subtype A) Guinea Pig Number | | | | B.JRFL 140CF (Subtype B) Guinea Pig Number | | | | C.97ZA012 140CFI (Subtype C) Guinea Pig Number | | | | DU123 140CF (Subtype C) Guinea Pig Number | | | |
|---|---|---|---|---|---|---|---|---|---|---|---|---|---|---|---|---|
| (Subtype) | 854 | 855 | 856 | 857 | 791 | 793 | 796 | 797 | 862 | 863 | 864 | 865 | 1349 | 1350 | 1351 | 1352 |
| B.BX08# | <20 | <20 | <20 | <20 | 23 | 22 | <20 | <20 | <20 | <20 | <20 | <20 | | | | |
| B.QH0692.42 | 34 | <20 | <20 | 36 | 108 | <20 | <20 | <20 | <20 | <20 | <20 | <20 | 37 | 45 | 39 | 38 |
| B.SS1196.1 | 115 | 83 | 100 | 150 | 2,203 | 2,095 | 506 | 489 | 23 | 27 | <20 | <20 | 73 | 72 | 85 | 59 |
| B.SF162.LS | 1,546 | 412 | 1,301 | 984 | 1,489 | 1,888 | 92 | 290 | 128 | 421 | 88 | 106 | 306 | 877 | 56 | 103 |
| B. BaL.26 | 60 | 38 | 91 | 41 | >540 | >540 | >540 | ND | 24 | 32 | 20 | 20 | 50 | 44 | 43 | 37 |
| 92US715 | 24 | <20 | 23 | 21 | <20 | 77 | 127 | ND | <20 | <20 | <20 | <20 | 40 | 91 | 88 | 74 |
| B.JRFL-MC** | <20 | <20 | <20 | <20 | <20 | <20 | <20 | <20 | <20 | <20 | <20 | <20 | 26 | <20 | 35 | 31 |
| B.6101 | <20 | <20 | <20 | <20 | <20 | <20 | <20 | <20 | <20 | <20 | <20 | <20 | <20 | 68 | 33 | 27 |
| B.7165 | 44 | 37 | 45 | 46 | <20 | <20 | <20 | ND | <20 | <20 | <20 | <20 | | | | |
| QH0515 | 26 | 24 | 25 | <20 | 42 | <20 | <20 | ND | <20 | 22 | 20 | 32 | 65 | 119 | 106 | 45 |
| B.3988 | <20 | <20 | <20 | <20 | <20 | <20 | <20 | <20 | <20 | <20 | <20 | <20 | 27 | 83 | 47 | 43 |
| B.BG1168 | <20 | <20 | <20 | <20 | <20 | <20 | <20 | <20 | <20 | <20 | <20 | <20 | 21 | 37 | 32 | 21 |
| ARI.29 | <20 | <20 | <20 | <20 | <20 | <20 | 29 | ND | <20 | <20 | <20 | <20 | | | | |
| PAVO | <20 | 21 | 20 | <20 | <20 | <20 | <20 | 26 | <20 | <20 | <20 | <20 | 22 | 87 | 26 | 25 |
| TORNO | 27 | 21 | 27 | <20 | <20 | <20 | 30 | ND | 24 | <20 | <20 | <20 | | | | |
| WITO | <20 | <20 | <20 | <20 | <20 | <20 | <20 | <20 | <20 | 35 | <20 | <20 | 98 | 110 | 85 | 61 |
| C.TV-1.21 | 540 | 443 | 449 | 711 | <20 | <20 | <20 | <20 | 93 | 148 | <20 | <20 | 424 | 240 | 182 | 80 |
| C.DU123 | 41 | <20 | 48 | 37 | <20 | <20 | <20 | <20 | <20 | 115 | <20 | <20 | 450 | 210 | 170 | 60 |
| C.DU172.17 | <20 | <20 | <20 | <20 | <20 | <20 | <20 | <20 | <20 | <20 | <20 | <20 | >540 | 283 | 481 | 118 |
| C.DU151.2 | <20 | <20 | <20 | <20 | <20 | <20 | <20 | <20 | <20 | <20 | <20 | <20 | 41 | 131 | 72 | 46 |
| C.DU156.12 | <20 | <20 | <20 | <20 | <20 | <20 | <20 | <20 | <20 | <20 | <20 | <20 | 97 | 108 | 58 | 58 |
| C.DU422.01 | <20 | <20 | <20 | <20 | <20 | <20 | <20 | <20 | <20 | <20 | <20 | <20 | 134 | 122 | 81 | 54 |
| C.97ZA012.29 | <20 | <20 | <20 | <20 | <20 | <20 | 36 | 20 | <20 | <20 | <20 | <20 | 35 | 82 | 52 | 41 |
| C.96ZM651.2 | <20 | <20 | <20 | <20 | <20 | <20 | <20 | <20 | <20 | <20 | <20 | <20 | 53 | 90 | 49 | 38 |
| C.92BR025.9 | 403 | 168 | 258 | 311 | <20 | <20 | <20 | <20 | 55 | 50 | <20 | 39 | 227 | 356 | 315 | 253 |
| C.02ZM233M.PB6 | <20 | <20 | <20 | <20 | <20 | <20 | <20 | <20 | <20 | <20 | <20 | <20 | 462 | 323 | 177 | 141 |
| C.02ZM197M.PB7 | <20 | <20 | <20 | 27 | 23 | 22 | <20 | <20 | 21 | 22 | <20 | <20 | 435 | 178 | 115 | 61 |
| A.92RW020.05 | 150 | 71 | 100 | 106 | <20 | <20 | <20 | <20 | <20 | <20 | <20 | <20 | 224 | 310 | 163 | 77 |
| A.92UG037.01 | <20 | <20 | <20 | <20 | <20 | <20 | <20 | <20 | <20 | <20 | <20 | <20 | 483 | 214 | 162 | 109 |
| A.Q23 | <20 | <20 | <20 | <20 | <20 | <20 | <20 | <20 | <20 | <20 | <20 | <20 | 33 | 80 | 50 | 46 |
| A.Q168 | <20 | <20 | <20 | <20 | <20 | <20 | <20 | <20 | <20 | <20 | <20 | <20 | 34 | 108 | 50 | 45 |
| A.Q259 | <20 | <20 | <20 | <20 | <20 | <20 | <20 | <20 | <20 | <20 | <20 | <20 | 480 | 178 | 349 | 93 |
| A.Q461 | <20 | <20 | <20 | <20 | <20 | <20 | <20 | <20 | <20 | <20 | <20 | <20 | 28 | 106 | 55 | 39 |
| A.Q769 | <20 | <20 | <20 | <20 | <20 | <20 | <20 | <20 | <20 | <20 | <20 | <20 | 368 | 328 | 325 | 76 |
| A.Q842 | <20 | <20 | <20 | <20 | <20 | <20 | <20 | <20 | <20 | <20 | <20 | <20 | >540 | 111 | 378 | 82 |
| A/E.93TH976 | <20 | <20 | <20 | <20 | <20 | <20 | <20 | <20 | <20 | <20 | <20 | <20 | 59 | 229 | 111 | 38 |

Fig 128 cont'd

Neutralization Titers Of Guinea Pig Serum Induced With Wild-type Envelope Oligomers

| HIV-1 Isolate (Subtype) | A.00KE_MSA4076-A Subtype A) Guinea Pig Number | | | | B.JRFL (Subtype B) Guinea Pig Number | | | | C.DU123 140CF (Subtype C) Guinea Pig Number | | | | G.DRCBL-G (Subtype G) Guinea Pig Number | | | | AE_01.97CNGX2F-AE (Subtype AE_01) Guinea Pig Number | | | |
|---|---|---|---|---|---|---|---|---|---|---|---|---|---|---|---|---|---|---|---|---|
| | 1369 | 1370 | 1371 | 1372 | 1414 | 1415 | 1416 | 1417 | 1349 | 1350 | 1351 | 1352 | 1393 | 1394 | 1395 | 1396 | 1397 | 1398 | 1399 | 1401 |
| B.QH0692.42 | | | | | | | | | 37 | 45 | 39 | 38 | | | | | | | | |
| B.SS1196.1 | | | | | | | | | 73 | 72 | 85 | 59 | | | | | | | | |
| B.SF162.LS | | | | | | | | | 306 | 877 | 56 | 103 | | | | | | | | |
| B. BaL.26 | | | | | | | | | 50 | 44 | 43 | 37 | | | | | | | | |
| 92US715 | | | | | | | | | 40 | 91 | 88 | 74 | | | | | | | | |
| B.JRFL-MC** | | | | | | | | | 26 | <20 | 35 | 31 | | | | | | | | |
| B.6101 | | | | | | | | | <20 | 68 | 33 | 27 | | | | | | | | |
| B.7165 | | | | | | | | | | | | | | | | | | | | |
| QH0515 | | | | | | | | | 65 | 119 | 106 | 45 | | | | | | | | |
| B.3988 | | | | | | | | | 27 | 83 | 47 | 43 | | | | | | | | |
| B.BG1168 | | | | | | | | | 21 | 37 | 32 | 21 | | | | | | | | |
| ARI.29 | | | | | | | | | | | | | | | | | | | | |
| PAVO | | | | | | | | | 22 | 87 | 26 | 25 | | | | | | | | |
| TORNO | | | | | | | | | | | | | | | | | | | | |
| WITO | | | | | | | | | 98 | 110 | 85 | 61 | | | | | | | | |
| C.TV-1.21 | | | | | | | | | 424 | 240 | 182 | 80 | | | | | | | | |
| C.DU123 | | | | | | | | | 450 | 210 | 170 | 60 | | | | | | | | |
| C.DU172.17 | | | | | | | | | >540 | 283 | 481 | 118 | | | | | | | | |
| C.DU151.2 | | | | | | | | | 41 | 131 | 72 | 46 | | | | | | | | |
| C.DU156.12 | | | | | | | | | 97 | 108 | 58 | 58 | | | | | | | | |
| C.DU422.01 | | | | | | | | | 134 | 122 | 81 | 54 | | | | | | | | |
| C.97ZA012.29 | | | | | | | | | 35 | 82 | 52 | 41 | | | | | | | | |
| C.96ZM651.2 | | | | | | | | | 53 | 90 | 49 | 38 | | | | | | | | |
| C.92BR025.9 | | | | | | | | | 227 | 356 | 315 | 253 | | | | | | | | |
| C.02ZM233M.PB6 | | | | | | | | | 462 | 323 | 177 | 141 | | | | | | | | |
| C.02ZM197M.PB7 | | | | | | | | | 435 | 178 | 115 | 61 | | | | | | | | |
| A.92RW020.05 | | | | | | | | | 224 | 310 | 163 | 77 | | | | | | | | |
| A.92UG037.01 | | | | | | | | | 483 | 214 | 162 | 109 | | | | | | | | |
| A.Q23 | | | | | | | | | 33 | 80 | 50 | 46 | | | | | | | | |
| A.Q168 | | | | | | | | | 34 | 108 | 50 | 45 | | | | | | | | |
| A.Q259 | | | | | | | | | 480 | 178 | 349 | 93 | | | | | | | | |
| A.Q461 | | | | | | | | | 28 | 106 | 55 | 39 | | | | | | | | |
| A.Q769 | | | | | | | | | 368 | 328 | 325 | 76 | | | | | | | | |
| A.Q842 | | | | | | | | | >540 | 111 | 378 | 82 | | | | | | | | |
| A/E.93TH976 | | | | | | | | | 59 | 229 | 111 | 38 | | | | | | | | |

Fig. 128 cont'd

Conclusions

- Utilizing "original antigenic sin" thus far has not had profound effects on induction of Nabs.
- Varying the dose of Env has not had profound effects on induction of Nabs.
- Varying the adjuvants has not had profound effects on induction of Nabs.

Fig. 128 cont'd

Conclusions

- Group M consensus 2001 CON-S, 2003 CON-T, subtype A.Con, C.Con, G.Con are all similar in induction of antibodies that neutralize in the pseudovirus neut. assay.

- The best neutralizing antibody inducers we have thus far are the acute Env C.DU123 and the B.JRFL CD4 Binding site mutant, APA gp140CF Env oligomers.

Fig. 128 cont'd

Effect of Intermediate Doses of Env Oligomer on Neutralzing Antibody Responses 25 ug, 50ug vs 100ug

Fig. 128 cont'd

Comparison of Immunization Dose of CON-S 140CFI Env For Inducuon of Neutralization Antibodies In Guinea Pigs

| HIV-1 Isolate | 0.1ugx4, 100ugx1 CON-S 140CFI 25ugx4, Guinea Pig Number | | | | 1ugx4, 100ugx1 CON-S 140CFI Guinea Pig Number | | | | 25ugx4, 100ugx1 CON-S 140CFI 25ugx4, Guinea Pig Number | | | 50ugx4, 100ugx1 CON-S 140CFI Guinea Pig Number | | 100ug x 5 CON-S 140CFI 25ugx4, Guinea Pig Number | | | |
|---|---|---|---|---|---|---|---|---|---|---|---|---|---|---|---|---|---|
| (Subtype) | 1308 | 1309 | 1310 | 1311 | 1312 | 1313 | 1314 | 1315 | 1357 | 1358 | 1360 | 1361 | 1362 | 1316 | 1317 | 1318 | 1319 |
| MN | 587 | 5,270 | 13,380 | 108 | 10,189 | 4,554 | 6,840 | 43,740 | | | | | | 3,209 | 4,218 | 709 | 3,423 |
| B.QH0692.42 | 98 | 91 | 540 | 83 | <20 | <20 | <20 | <20 | <20 | 44 | 37 | <20 | <20 | <20 | <20 | <20 | <20 |
| B.SS1196.1 | >540 | >540 | >540 | 25 | 1,294 | 156 | 497 | 1,687 | 10,428 | 4,370 | 10,787 | 1,220 | 2,130 | 738 | 600 | 232 | 1,794 |
| B.SF162.LS | >540 | >540 | >540 | >540 | 7,244 | 1,050 | 1,269 | 2,258 | 34,048 | 99,110 | 133 | 7,310 | 12,834 | 11,184 | 3,796 | 1,431 | 4,987 |
| B. BaL.26 | 214 | 372 | >540 | <20 | | | | | 148 | 3,260 | 236 | 54 | 59 | | | | |
| 92US715 | | | | | | | | | 46 | 66 | 49 | 23 | 32 | | | | |
| B.JRFL-MC** | | | | | | | | | <20 | 24 | <20 | <20 | <20 | | | | |
| B.6101 | | | | | | | | | <20 | <20 | <20 | <20 | <20 | | | | |
| B.6535 | <20 | <20 | <20 | <20 | 54 | 43 | 87 | 178 | | | | | | 353 | 90 | 105 | 804 |
| QH0515 | | | | | | | | | <20 | <20 | <20 | <20 | <20 | | | | |
| B.3988 | | | | | | | | | <20 | <20 | <20 | <20 | <20 | | | | |
| B.BG1168 | | | | | | | | | <20 | <20 | <20 | <20 | 28 | | | | |
| WITO | | | | | | | | | <20 | <20 | | | | | | | |
| C.TV-1.21 | >540 | >540 | >540 | >540 | | | | | 3,118 | 2,370 | 5,637 | >540 | 525 | | | | |
| C.DU123 | 100 | 108 | 266 | <20 | | | | | 192 | 366 | 298 | 186 | 53 | | | | |
| C.DU172.17 | | | | | | | | | | | | | | | | | |
| C.DU151.2 | | | | | | | | | 24 | 30 | 23 | <20 | 56 | | | | |
| C.DU156.12 | <20 | <20 | <20 | <20 | <20 | <20 | <20 | <20 | 36 | <20 | 39 | <20 | <20 | <20 | <20 | <20 | <20 |
| C.DU422.01 | | | | | | | | | 38 | 22 | <20 | <20 | <20 | | | | |
| C.97ZA012.29 | | | | | | | | | <20 | <20 | <20 | <20 | <20 | | | | |
| C.96ZM651.2 | | | | | | | | | 92 | 37 | 241 | <20 | 424 | | | | |
| C.92BR025.9 | | | | | | | | | >540 | >540 | >540 | >540 | >540 | | | | |
| A.92RW020.05 | | | | | | | | | 311 | 252 | 464 | 93 | 189 | | | | |

Fig. 28 cont'd

Neutralization Titers Of Guinea Pig Serum Induced With Wild-type Envelope Oligomers

| HIV-1 Isolate | A.92RW020 (Subtype A) Guinea Pig Number | | | | B.JRFL (Subtype B) Guinea Pig Number | | | | C. 97ZA012 (Subtype C) Guinea Pig Number | | | |
|---|---|---|---|---|---|---|---|---|---|---|---|---|
| (Subtype) | 854 | 855 | 856 | 857 | 791 | 793 | 796 | 797 | 862 | 863 | 864 | 865 |
| B.BX08# | <20 | <20 | <20 | <20 | 23 | 22 | <20 | <20 | <20 | <20 | <20 | <20 |
| B.QH0692.42 | **34** | <20 | <20 | **36** | **108** | <20 | <20 | <20 | <20 | <20 | <20 | <20 |
| B.SS1196.1 | **115** | **83** | **100** | **150** | **2,203** | **2,095** | **506** | **489** | 23 | 27 | <20 | <20 |
| B.SF162.LS | **1,546** | **412** | **1,301** | **984** | **1,489** | **1,888** | **92** | **290** | **128** | **421** | **88** | **106** |
| B. BaL.26 | **60** | **38** | **91** | **41** | **>540** | **>540** | **>540** | ND | 24 | **32** | 20 | 20 |
| 92US715 | 24 | <20 | 23 | 21 | <20 | **77** | **127** | ND | <20 | <20 | <20 | <20 |
| B.JRFL-MC** | <20 | <20 | <20 | <20 | <20 | <20 | <20 | <20 | <20 | <20 | <20 | <20 |
| B.6101 | <20 | <20 | <20 | <20 | <20 | <20 | <20 | <20 | <20 | <20 | <20 | <20 |
| B.7165 | **44** | **37** | **45** | **46** | <20 | <20 | <20 | ND | <20 | <20 | <20 | <20 |
| QH0515 | 26 | 24 | 25 | <20 | **42** | <20 | <20 | ND | <20 | 22 | 20 | 32 |
| B.3988 | <20 | <20 | <20 | <20 | <20 | <20 | <20 | <20 | <20 | <20 | <20 | <20 |
| B.BG1168 | <20 | <20 | <20 | <20 | <20 | <20 | <20 | <20 | <20 | <20 | <20 | <20 |
| ARI.29 | <20 | <20 | <20 | <20 | <20 | <20 | 29 | ND | <20 | <20 | <20 | <20 |
| PAVO | <20 | 21 | 20 | <20 | <20 | <20 | <20 | 26 | <20 | <20 | <20 | <20 |
| TORNO | 27 | 21 | 27 | <20 | <20 | <20 | 30 | ND | 24 | <20 | <20 | <20 |
| WITO | <20 | <20 | <20 | <20 | <20 | <20 | <20 | <20 | <20 | 35 | <20 | <20 |
| C.TV-1.21 | **540** | **443** | **449** | **711** | <20 | <20 | <20 | <20 | **93** | **148** | <20 | <20 |
| C.DU123 | **41** | <20 | **48** | **37** | <20 | <20 | <20 | <20 | <20 | **115** | <20 | <20 |
| C.DU172.17 | <20 | <20 | <20 | <20 | <20 | <20 | <20 | <20 | <20 | <20 | <20 | <20 |
| C.DU151.2 | <20 | <20 | <20 | <20 | <20 | <20 | <20 | <20 | <20 | <20 | <20 | <20 |
| C.DU156.12 | <20 | <20 | <20 | <20 | <20 | <20 | <20 | <20 | <20 | <20 | <20 | <20 |
| C.DU422.01 | <20 | <20 | <20 | <20 | <20 | <20 | <20 | <20 | <20 | <20 | <20 | <20 |
| C.97ZA012.29 | <20 | <20 | <20 | <20 | <20 | <20 | **36** | 20 | <20 | <20 | <20 | <20 |
| C.96ZM651.2 | <20 | <20 | <20 | <20 | <20 | <20 | <20 | <20 | <20 | <20 | <20 | <20 |
| C.92BR025.9 | **403** | **168** | **258** | **311** | <20 | <20 | <20 | <20 | **55** | **50** | <20 | **39** |
| C.02ZM233M.PB6 | <20 | <20 | <20 | <20 | <20 | <20 | <20 | <20 | <20 | <20 | <20 | <20 |
| C.02ZM197M.PB7 | <20 | <20 | <20 | 27 | 23 | 22 | <20 | <20 | 21 | 22 | <20 | <20 |
| A.92RW020.05 | **150** | **71** | **100** | **106** | <20 | <20 | <20 | <20 | <20 | <20 | <20 | <20 |
| A.92UG037.01 | <20 | <20 | <20 | <20 | <20 | <20 | <20 | <20 | <20 | <20 | <20 | <20 |
| A.Q23 | <20 | <20 | <20 | <20 | <20 | <20 | <20 | <20 | <20 | <20 | <20 | <20 |
| A.Q168 | <20 | <20 | <20 | <20 | <20 | <20 | <20 | <20 | <20 | <20 | <20 | <20 |
| A.Q259 | <20 | <20 | <20 | <20 | <20 | <20 | <20 | <20 | <20 | <20 | <20 | <20 |
| A.Q461 | <20 | <20 | <20 | <20 | <20 | <20 | <20 | <20 | <20 | <20 | <20 | <20 |
| A.Q769 | <20 | <20 | <20 | <20 | <20 | <20 | <20 | <20 | <20 | <20 | <20 | <20 |
| A.Q842 | <20 | <20 | <20 | <20 | <20 | <20 | <20 | <20 | <20 | <20 | <20 | <20 |
| A/E.93TH976 | <20 | <20 | <20 | <20 | <20 | <20 | <20 | <20 | <20 | <20 | <20 | <20 |

Figure 128 cont'd

Neutralization Titers Of Guinea Pig Primed and Boost With Different Immunogens Expressing CD4 Binding Site or 2F5 Binding Sites

| HIV-1 Isolate | CON-S x1, US-1 x3 | | | | US-1 x1, CON-S x3 | | | US-1 x1, CON-S x1, JRFL x1 | | | | CON-S x1, US-1 x1, JRFL x1 | | | DP178Q16L x1, JRFL x1 | | | |
|---|---|---|---|---|---|---|---|---|---|---|---|---|---|---|---|---|---|---|
| | Guinea Pig Number | | | | Guinea Pig Number | | | Guinea Pig Number | | | | Guinea Pig Number | | | Guinea Pig Number | | | |
| (Subtype) | 1324 | 1325 | 1326 | 1327 | 1328 | 1329 | 1331 | 1332 | 1333 | 1334 | 1335 | 1336 | 1338 | 1340 | 1341 | 1342 | 1343 | 1344 |
| B.BX08# | | | | | | | | | | | | | | | | | | |
| B.QH0692.42 | 33 | 57 | 61 | 54 | 75 | 67 | 68 | 49 | 42 | 43 | 58 | 88 | 74 | 75 | 92 | 80 | 73 | 85 |
| B.SS1196.1 | <20 | 27 | 44 | 48 | 134 | 231 | 260 | 95 | 115 | 78 | 120 | 265 | 405 | 205 | 509 | 298 | 281 | 314 |
| B.SF162.LS | 55 | 127 | 295 | 240 | >540 | >540 | >540 | >540 | >540 | >540 | >540 | >540 | >540 | >540 | 355 | 397 | 298 | 265 |
| B. BaL.26 | 26 | 38 | 50 | 38 | 145 | 104 | 141 | 77 | 84 | 59 | 129 | 224 | 381 | 280 | >540 | 289 | 181 | 284 |
| 92US715 | | | | | | | | | | | | <20 | <20 | <20 | | | | |
| B.JRFL-MC** | | | | | | | | | | | | <20 | <20 | <20 | | | | |
| B.6101 | | | | | | | | | | | | <20 | <20 | <20 | | | | |
| B.6535 | <20 | <20 | 22 | <20 | 40 | 177 | 121 | <20 | 30 | <20 | 31 | 88 | 105 | 96 | <20 | <20 | <20 | <20 |
| B.3988 | | | | | | | | | | | | 41 | <20 | 21 | | | | |
| B.BG1168 | <20 | <20 | <20 | <20 | <20 | <20 | <20 | <20 | <20 | 23 | <20 | <20 | <20 | <20 | 22 | 21 | <20 | <20 |
| ARI.29 | | | | | | | | | | | | | | | | | | |
| PAVO | <20 | 21 | 25 | <20 | <20 | <20 | <20 | <20 | <20 | 53 | 21 | <20 | <20 | <20 | <20 | <20 | <20 | <20 |
| TORNO | | | | | | | | | | | | | | | | | | |
| WITO | | | | | | | | | | | | <20 | <20 | <20 | | | | |
| C.TV-1.21 | 37 | 54 | 78 | 78 | 472 | 393 | 297 | 131 | 114 | 117 | 242 | 360 | >540 | 378 | 25 | 35 | <20 | <20 |
| C.DU123 | 82 | 112 | 126 | 79 | 108 | 130 | 113 | 104 | 109 | 118 | 72 | 115 | 85 | 50 | 34 | 51 | 35 | <20 |

Inhibition Of Soluble CD4 Binding By Serum Of Guinea Pigs Immunized With HIV-1 Envelope Proteins

☐ Assayed on B.JRFL Env

HIV-1 Envelope gp140 Immunogens: A.92RW020, B.JRFL, C.97ZA012, CON-S

MODIFIED HIV-1 CLADE C ENVELOPE GLYCOPROTEIN IMMUNOGENS COMPRISING DELETIONS IN THE GP120/GP41 CLEAVAGE SITE AND GP41 FUSION DOMAIN

This application is a continuation-in-part of U.S. application Ser. No. 10/572,638, filed Dec. 22, 2006, which is the U.S. national phase of International Appln. PCT/US2004/030397 filed Sep. 17, 2004, which designates the U.S. and which claims priority from Prov. Appln. No. 60/503,460, filed Sep. 17, 2003, and Prov. Appln. No. 60/604,722, filed Aug. 27, 2004, the entire contents of which are incorporated herein by reference.

The contents of the attached CD-R compact discs are incorporated herein by reference in their entirety. The attached discs contain identical copies a file "sequence.txt" which were created on the discs on Feb. 13, 2009, and are each 1.03 MB.

TECHNICAL FIELD

The present invention relates, in general, to an immunogen and, in particular, to an immunogen for inducing antibodies that neutralize a wide spectrum of HIV primary isolates and/or to an immunogen that induces a T cell immune response. The invention also relates to a method of inducing anti-HIV antibodies, and/or to a method of inducing a T cell immune response, using such an immunogen. The invention further relates to nucleic acid sequences encoding the present immunogens.

BACKGROUND

The high level of genetic variability of HIV-1 has presented a major hurdle for AIDS vaccine development. Genetic differences among HIV-1 groups M, N, and O are extensive, ranging from 30% to 50% in gag and env genes, respectively (Gurtler et al, J. Virol. 68:1581-1585 (1994), Vanden Haesevelde et al, J. Virol. 68:1586-1596 (1994), Simon et al, Nat. Med. 4:1032-1037 (1998), Kuiken et al, Human retroviruses and AIDS 2000: a compilation and analysis of nucleic acid and amino acid sequences (Theoretical Biology and Biophysics Group, Los Alamos National Laboratory, Los Alamos, N. Mex.)). Viruses within group M are further classified into nine genetically distinct subtypes (A-D, F-H, J and K) (Kuiken et al, Human retroviruses and AIDS 2000: a compilation and analysis of nucleic acid and amino acid sequences (Theoretical Biology and Biophysics Group, Los Alamos National Laboratory, Los Alamos, N. Mex., Robertson et al, Science 288:55-56 (2000), Robertson et al, Human retroviruses and AIDS 1999: a compilation and analysis of nucleic acid and amino acid sequences, eds. Kuiken et al (Theoretical Biology and Biophysics Group, Los Alamos National Laboratory, Los Alamos, N. Mex.), pp. 492-505 (2000)). With the genetic variation as high as 30% in env genes among HIV-1 subtypes, it has been difficult to consistently elicit cross-subtype T and B cell immune responses against all HIV-1 subtypes. HIV-1 also frequently recombines among different subtypes to create circulating recombinant forms (CRFs) (Robertson et al, Science 288:55-56 (2000), Robertson et al, Human retroviruses and AIDS 1999: a compilation and analysis of nucleic acid and amino acid sequences, eds. Kuiken et al (Theoretical Biology and Biophysics Group, Los Alamos National Laboratory, Los Alamos, N. Mex.), pp. 492-505 (2000), Carr et al, Human retroviruses and AIDS 1998: a compilation and analysis of nucleic acid and amino acid sequences, eds. Korber et al (Theoretical Biology and Biophysics Group, Los Alamos National Laboratory, Los Alamos, N. Mex.), pp. III-10-III-19 (1998)). Over 20% of HIV-1 isolates are recombinant in geographic areas where multiple subtypes are common (Robertson et al, Nature 374:124-126 (1995), Cornelissen et al, J. virol. 70:8209-8212 (1996), Dowling et al, AIDS 16:1809-1820 (2002)), and high prevalence rates of recombinant viruses may further complicate the design of experimental HIV-1 immunogens.

To overcome these challenges in AIDS vaccine development, three computer models (consensus, ancestor and center of the tree) have been used to generate centralized HIV-1 genes to (Gaschen et al, Science 296:2354-2360 (2002), Gao et al, Science 299:1517-1518 (2003), Nickle et al, Science 299:1515-1517 (2003), Novitsky et al, J. Virol. 76:5435-5451 (2002), Ellenberger et al, Virology 302:155-163 (2002.), Korber et al, Science 288:1789-1796 (2000)). The biology of HIV gives rise to star-like phylogenies, and as a consequence of this, the three kinds of sequences differ from each other by 2-5% (Gao et al, Science 299:1517-1518 (2003)). Any of the three centralized gene strategies will reduce the protein distances between immunogens and field virus strains. Consensus sequences minimize the degree of sequence dissimilarity between a vaccine strain and contemporary circulating viruses by creating artificial sequences based on the most common amino acid in each position in an alignment (Gaschen et al, Science 296:2354-2360 (2002)). Ancestral sequences are similar to consensus sequences but are generated using maximum-likelihood phylogenetic analysis methods (Gaschen et al, Science 296:2354-2360 (2002), Nickle et al, Science 299:1515-1517 (2003)). In doing so, this method recreates the hypothetical ancestral genes of the analyzed current wild-type sequences (FIG. 26). Nickle et al proposed another method to generate centralized HIV-1 sequences, center of the tree (COT), that is similar to ancestral sequences but less influenced by outliers (Science 299:1515-1517 (2003)).

The present invention results, at least in part, from the results of studies designed to determine if centralized immunogens can induce both T and B cell immune responses in animals. These studies involved the generation of an artificial group M consensus env gene (CON6), and construction of DNA plasmids and recombinant vaccinia viruses to express CON6 envelopes as soluble gp120 and gp140CF proteins. The results demonstrate that CON6 Env proteins are biologically functional, possess linear, conformational and glycan-dependent epitopes of wild-type HIV-1, and induce cytokine-producing T cells that recognize T cell epitopes of both HIV subtypes B and C. Importantly, CON6 gp120 and gp140CF proteins induce antibodies that neutralize subsets of subtype B and C HIV-1 primary isolates.

The iterative nature of study of the centralized HIV-1 gene approach is derived from the rapidly expanding evolution of HIV-1 sequences, and the fact that sequences collected in the HIV sequence database (that is, the Los Alamos National Database) are continually being updated with new sequences each year. The CON6 gp120 envelope gene derives from Year 1999 Los Alamos National Database sequences, and Con-S derives from Year 2000 Los Alamos National Database sequences. In addition, CON6 has Chinese subtype C V1, V2, V4, and V5 Env sequences, while Con-S has all group M consensus Env constant and variable regions, that have been shortened to minimal-length variable loops. Codon-optimized genes for a series of Year 2003 group M and subtype consensus sequences have been designed, as have a corresponding series of wild-type HIV-1 Env genes for comparison, for use in inducing broadly reactive T and B cell responses to HIV-1 primary isolates.

SUMMARY OF THE INVENTION

The present invention relates to an immunogen for inducing antibodies that neutralize a wide spectrum of HIV primary isolates and/or to an immunogen that induces a T cell immune response, and to nucleic acid sequences encoding same. The invention also relates to a method of inducing anti-HIV antibodies, and/or to a method of inducing a T cell immune response, using such an immunogen.

Objects and advantages of the present invention will be clear from the description that follows.

BRIEF DESCRIPTION OF THE DRAWINGS

FIGS. 1A-1D: Generation and expression of the group M consensus env gene (CON6). The complete amino acid sequence of CON6 gp160 is shown. (FIG. 1A) (SEQ ID NO:1) The five regions from the wild-type CRF08_BC (98CN006) env gene are indicated by underlined letters. Variable regions are indicated by brackets above the sequences. Potential N-liked glycosylation sites are highlighted with bold-faced letters. (FIG. 1B) Constructs of CON6 gp120 and gp140CF. CON6 gp120 and gp140CF plasmids were engineered by introducing a stop codon after the gp120 cleavage site or before the transmembrane domain, respectively. The gp120/gp41 cleavage site and fusion domain of gp41 were deleted in the gp140CF protein. (FIG. 1C) Expression of CON6 gp120 and gp140CF. CON6 gp120 and gp140CF were purified from the cell culture supernatants of rVV-infected 293T cells with *galanthus Nivalis argarose* lectin columns. Both gp120 and gp140CF were separated on a 10% SDS-polyarylamide gel and stained with Commassie blue. (FIG. 1D.) (SEQ ID NO:2) CON6 env gene optimized based on codon usage for highly expressed human genes.

(FIGS. 2A-2B) Each of the indicated mabs and sCD4 was covalently immobilized to a CM5 sensor chip (BIAcore) and CON6 gp120 (FIG. 2A) or gp140CF (FIG. 2B)(100 μg/ml and 300 μg/ml, respectively) were injected over each surface. Both gp120 and gp140CF proteins reacted with each anti-gp120 mabs tested except for17b mab, which showed negligible binding to both CON6 gp120 and gp140CF. To determine induction of 17b mab binding to CON6 gp120 and gp140CF, CON6 gp120 (FIG. 2C) or gp140CF (FIG. 2D) proteins were captured (400-580 RU) on individual flow cells immobilized with sCD4 or mabs A32 or T8. Following stabilization of each of the surface, mAb 17b was injected and flowed over each of the immobilized flow cells. Overlay of curves show that the binding of mab 17b to CON6 Env proteins was markedly enhanced on both sCD4 and mab A32 surfaces but not on the T8 surface (FIGS. 2C-2D). To determine binding of CON6 gp120 and gp140CF to human mabs in ELISA, stock solutions of 20 μg/ml of mabs 447, F39F, A32, IgG1b12 and 2F5 on CON6 gp120 and gp140CF were tittered (FIG. 2E). Mabs 447 (V3), F39F (V3) A32 (gp120) and IgG1b12 (CD4 binding site) each bound to both CON6 gp120 and 140 well, while 2F5 (anti-gp41 ELDKWAS) (SEQ ID NO:321) only bound gp140CF. The concentration at endpoint titer on gp120 for mab 447 and F39F binding was <0.003 μg/ml and 0.006 μg/ml respectively; for mab A32 was <0.125 μg/ml; for IgG1b12 was <0.002 μg/ml; and for 2F5 was 0.016 μg/ml.

(FIG. 3A) CON6 and control env plasmids were cotransfected with HIV-1/SG3Δenv backbone into human 293T cells to generate Env-pseudovirions. Equal amounts of each pseudovirion (5 ng p24) were used to infect JC53-BL cells. The infectivity was determined by counting the number of blue cells (infectious units, IU) per microgram of p24 of pseudovirions (IU/μg p24) after staining the infected cells for β-gal expression. (FIG. 3B) Coreceptor usage of the CON6 env gene was determined on JC53BL cells treated with AMD3100 and/or TAK-799 for 1 hr (37° C.) then infected with equal amounts of p24 (5 ng) of each Env-pseudovirion. Infectivity in the control group (no blocking agent) was set as 100%. Blocking efficiency was expressed as the percentage of IU from blocking experiments compared to those from control cultures without blocking agents. Data shown are mean±SD.

FIGS. 6A-6E. Construction of codon usage optimized subtype C ancestral and consensus envelope genes (FIGS. 6A and 6B, respectively) (SEQ ID NOS:3-4). Ancestral and consensus amino acid sequences (FIGS. 6C and 6D, respectively) (SEQ ID NOS:5-6) were transcribed to mirror the codon usage of highly expressed human genes. Paired oligonucleotides (80-mers) overlapping by 20 by were designed to contain 5' invariant sequences including the restriction enzyme sites EcoRI, BbsI, Bam HI and BsmBI. BbsI and BsmBI are Type II restriction enzymes that cleave outside of their recognition sequences. Paired oligomers were linked individually using PCR and primers complimentary to the 18 by invariant sequences in a stepwise fashion, yielding 140 bp PCR products. These were subcloned into pGEM-T and sequenced to confirm the absence of inadvertant mutations/deletions. Four individual pGEM-T subclones containing the proper inserts were digested and ligated together into pcDNA3.1. Multi-fragment ligations occurred repeatly amongst groups of fragments in a stepwise manner from the 5' to the 3' end of the gene until the entire gene was reconstructed in pcDNA3.1. (See schematic in FIG. 6E.)

FIG. 8. Sequence alignment of subtype C ancestral and consensus env genes. Alignment of the subtype C ancestral (bottom line) (SEQ ID NO:8) and consensus (top line) (SEQ ID NO:7) env sequences showing a 95.5% sequence homology; amino acid sequence differences are indicated. One noted difference is the addition of a glycosylation site in the C ancestral env gene at the base of the V1 loop. A plus sign indicates a within-class difference of amino acid at the indicated position; a bar indicates a change in the class of amino acid. Potential N-glycosylation sites are marked in blue. The position of truncation for the gp140 gene is also shown.

FIG. 10A. Trans complementation of env-deficient HIV-1 with codon-optimized subtype C ancestral and consensus gp160 and gp140. Plasmids containing codon-optimized, subtype C ancestral or consensus gp160 or gp140 genes were co-transfected into 293T cells with an HIV-1/SG3Δenv provirus. 48 hours post-transfection cell supernatants containing pseudotyped virus were harvested, clarified by centrifugation, filtered through at 0.2 μM filter, and pelleted through a 20% sucrose cushion. Quantification of p24 in each virus pellet was determined using the Coulter HIV-1 p24 antigen assay; 25 ng of p24 was loaded per lane on a 4-20% SDS-PAGE gel for particles containing a codon-optimized envelope. 250 ng of p24 was loaded per lane for particles generated by co-transfection of a rev-dependent wild-type subtype C 96ZAM651env gene. Differences in the amount of p24 loaded per lane were necessary to ensure visualization of the rev-dependent envelopes by Western Blot. Proteins were transferred to a PVDF membrane and probed with pooled plasma from HIV-1 subtype B and subtype C infected individuals. FIG. 10B. Infectivity of virus particles containing subtype C ancestral and consensus envelope glycoproteins. Infectivity of pseudotyped virus containing ancestral or consensus gp160 or gp140 envelope was determined using the JC53-BL assay. Sucrose cushion purified virus particles were assayed by the Coulter p24 antigen assay, and 5-fold serial dilutions of each pellet were incubated with DEAE-Dextran treated JC53-BL cells. Following a 48-hour incubation period, cells were fixed and stained to visualize β-galactosidase expressing cells. Infectivity is represented as infectious units per ng of p24 to normalize for differences in the concentration of the input pseudovirions.

FIGS. 13A-13F. Protein expression of consensus subtype C Gag (FIG. 13A) and Nef (FIG. 13B) following transfection into 293T cells. Consensus subtype C Gag and Nef amino acid sequences are set forth in FIGS. 13C and 13D, respectively, (SEQ ID NOS:9-10) and encoding sequences are set forth in FIGS. 13E and 13F, respectively (SEQ ID NOS:11-12).

FIGS. 14A-14C. FIGS. 14A and 14B show the Con-S Env amino acid sequence and encoding sequence, respectively (SEQ ID NOS:13-14). FIG. 14C shows expression of Group M consensus Con-S Env proteins using an in vitro transcription and translation system.

(FIG. 15A—cell lysate, FIG. 15B—supernatant.)

(FIG. 17A—lysate, FIG. 17B—supernatant, FIG. 17C pellet.)

FIGS. 18A-18D. FIGS. 18A and 18B show subtype A consensus Env amino acid sequence and nucleic acid sequence encoding same, respectively (SEQ ID NOS:15-16). FIGS. 18C and 18D show expression of A.con env gene in mammalian cells (FIG. 18C—cell lysate, FIG. 18D—supernatant).

FIGS. 19A-19H. M.con.gag (FIG. 19A) (SEQ ID NO:17), M.con.pol (FIG. 19B) (SEQ ID NO:18), M.con.nef (FIG. 19C) (SEQ ID NO:19) and C.con.pol (FIG. 19D) (SEQ ID NO:20) nucleic acid sequences and corresponding encoded amino acid sequences (FIGS. 19E-19H, respectively) (SEQ ID NOS:21-24).

FIGS. 20A-20D. Subtype B consensus gag (FIG. 20A) (SEQ ID NO:25) and env (FIG. 20B) (SEQ ID NO:26) genes. Corresponding amino acid sequences are shown in FIGS. 20C and 20D (SEQ ID NOS:28-29).

FIG. 23B. Infectivity of virus particles containing the subtype B concensus envelope. Infectivitiy of pseudotyped virus containing consensus B gp160 or gp140 was determined using the JC53-BL assay. Sucrose cushion purified virus particles were assayed by the Coulter p24 antigen assay, and 5-fold serial dilutions of each pellet were incubated with DEAE-Dextran treated JC53-BL cells. Following a 48-hour incubation period, cells were fixed and stained to visualize β-galactosidase expressing cells. Infectivity is expressed as infectious units per ng of p24.

FIG. 24A. Neutralization of Pseudovirions containing Subtype B consensus Env (gp160). FIG. 24B. Neutralization of Pseudovirions containing NL4.3 Env (gp160). FIG. 24C. Neutralization of Pseudovirions containing Subtype B consensus Env (gp160). FIG. 24D. Neutralization of Pseudovirions containing NL4.3 Env (gp160).

FIG. 25A. Density and p24 analysis of sucrose gradient fractions. 0.5 ml fractions were collected from a 20-60% sucrose gradient. Fraction number 1 represents the most dense fraction taken from the bottom of the gradient tube. Density was measured with a refractometer and the amount of p24 in each fraction was determined by the Coulter p24 antigen assay. Fractions 6-9, 10-15, 16-21, and 22-25 were pooled together and analyzed by Western Blot. As expected, virions sedimented at a density of 1.16-1.18 g/ml. FIG. 25B. VLP production by co-transfection of subtype B consensus gag and env genes. 293T cells were co-transfected with subtype B consensus gag and env genes. Cell supernatants were harvested 48-hours post-transfection, clarified through at 20% sucrose cushion, and further purified through a 20-60% sucrose gradient. Select fractions from the gradient were pooled, added to 20 ml of PBS, and centrifuged overnight at 100,000×g. Resuspended pellets were loaded onto a 4-20% SDS-PAGE gel, proteins were transferred to a PVDF membrane, and probed with plasma from an HIV-1 subtype B infected individual.

FIGS. 26A and 26B. FIG. 26A. 2000 Con-S 140CFI.ENV (SEQ ID NO:30). FIG. 26B. Codon-optimized Year 2000 Con-S 140CFI.seq (SEQ ID NO:31).

FIGS. 28A-28C. FIG. 28A. Con-B 2003 Env. pep (841 a.a.) (SEQ ID NO:32). Amino acid sequence underlined is the fusion domain that is deleted in 140CF design and the "W" underlined is the last amino acid at the C-terminus, all amino acids after the "W" are deleted in the 140CF design. FIG. 28B. Con-B-140CF.pep (632 a.a.) (SEQ ID NO:33). Amino acids in bold identify the junction of the deleted fusion cleavage site. FIG. 28C. Codon-optimized Con-B 140CF.seq (1927 nt.) (SEQ ID NO:34).

FIGS. 29A-29C. FIG. 29A. CON_OF_CONS-2003 (829 a.a.) (SEQ ID NO:35). Amino acid sequence underlined is the fusion domain that is deleted in 140CF design and the "W" underlined is the last amino acid at the C-terminus, all amino acids after the "W" are deleted in the 140CF design. FIG. 29B. ConS-2003 140CF.pep (620 a.a.) (SEQ ID NO:36). Amino acids in bold identify the junction of the deleted fusion cleavage site. FIG. 29C. CODON-OPTIMIZED ConS-2003 140CF.seq (1891 nt.) (SEQ ID NO:37).

FIGS. 30A-30C. FIG. 30A. CONSENSUS_A1-2003 (845 a.a.) (SEQ ID NO:38). Amino acid sequence underlined is the fusion domain that is deleted in 140CF design and the "W" underlined is the last amino acid at the C-terminus, all amino acids after the "W" are deleted in the 140CF design. FIG. 30B. Con-A1-2003 140CF.pep (629 a.a.) (SEQ ID NO:39). Amino acids in bold identify the junction of the deleted fusion cleavage site. FIG. 30C. CODON-OPTIMIZED Con-A1-2003.seq (SEQ ID NO:40).

FIGS. 31A-31C. FIG. 31A. CONSENSUS_C-2003 (835 a.a.) (SEQ ID NO:41). Amino acid sequence underlined is the fusion domain that is deleted in 140CF design and the "W" underlined is the last amino acid at the C-terminus, all amino acids after the "W" are deleted in the 140CF design. FIG. 31B. Con-C 2003 140CF.pep (619 a.a.) (SEQ ID NO:42). Amino acids in bold identify the junction of the deleted fusion cleavage site. FIG. 31C. CODON-OPTIMIZED Con-C-2003 (140 CF (1,888 nt.) (SEQ ID NO:43).

FIGS. 32A-32C. FIG. 32A. CONSENSUS_G-2003 (842 a.a.) (SEQ ID NO:44). Amino acid sequence underlined is the fusion domain that is deleted in 140CF design and the "W" underlined is the last amino acid at the C-terminus, all amino acids after the "W" are deleted in the 140CF design. FIG. 32B. Con-G-2003 140CF.pep (626 a.a.) (SEQ ID NO:45).

Amino acids in bold identify the junction of the deleted fusion cleavage site. FIG. 32C. CODON-OPTIMIZED Con-G-2003.seq (SEQ ID NO:46).

FIGS. 33A-33C. FIG. 33A. CONSENSUS_Ol_AE-2003 (854 a.a.) (SEQ ID NO:47). Amino acid sequence underlined is the fusion domain that is deleted in 140CF design and the "W" underlined is the last amino acid at the C-terminus, all amino acids after the "W" are deleted in the 140CF design. FIG. 33B. Con-AE01-2003 140CF.pep (638 a.a.) (SEQ ID NO:48). Amino acids in bold identify the junction of the deleted fusion cleavage site. FIG. 33C. CODON-OPTIMIZED Con-AE01-2003.seq. (1945 nt.) (SEQ ID NO:49).

FIGS. 34A-34C. FIG. 34A. Wild-type subtype A Env. 00KE_MSA4076-A (Subtype A, 891 a.a.) (SEQ ID NO:50). Amino acid sequence underlined is the fusion domain that is deleted in 140CF design and the "W" underlined is the last amino acid at the C-terminus, all amino acids after the "W" are deleted in the 140CF design. FIG. 34B. 00KE_MSA4076-A 140CF.pep (647 a.a.) (SEQ ID NO:51). Amino acids in bold identify the junction of the deleted fusion cleavage site. FIG. 34C. CODON-OPTIMIZED 00KE_MSA4076-A 140CF.seq. (1972 nt.) (SEQ ID NO:52).

FIGS. 35A-35C. FIG. 35A. Wild-type subtype B. QH0515.1g gp160 (861 a.a.) (SEQ ID NO:53). Amino acid sequence underlined is the fusion domain that is deleted in 140CF design and the "W" underlined is the last amino acid at the C-terminus, all amino acids after the "W" are deleted in the 140CF design. FIG. 35B. QH0515.1g 140CF (651 a.a.) (SEQ ID NO:54). Amino acids in bold identify the junction of the deleted fusion cleavage site. FIG. 35C. CODON-OPTIMIZED QH0515.1g 140CF.seq (1984 nt.) (SEQ ID NO:55).

FIGS. 36A-36C. FIG. 36A. Wild-type subtype C. DU123.6 gp160 (854 a.a.) (SEQ ID NO:56). Amino acid sequence underlined is the fusion domain that is deleted in 140CF design and the "W" underlined is the last amino acid at the C-terminus, all amino acids after the "W" are deleted in the 140CF design. FIG. 36B. DU123.6 140CF (638 a.a.) (SEQ ID NO:57). Amino acids in bold identify the junction of the deleted fusion cleavage site. FIG. 36C. CODON-OPTIMIZED DU123.6 140CF.seq (1945 nt.) (SEQ ID NO:58).

FIGS. 37A-37C. FIG. 37A. Wild-type subtype CRF01_AE. 97CNGX2F-AE (854 a.a.) (SEQ ID NO:59). Amino acid sequence underlined is the fusion domain that is deleted in 140CF design and the "W" underlined is the last amino acid at the C-terminus, all amino acids after the "W" are deleted in the 140CF design. FIG. 37B. 97CNGX2F-AE 140CF.pep (629 a.a.) (SEQ ID NO:60). Amino acids in bold identify the junction of the deleted fusion cleavage site. FIG. 37C. CODON-OPTIMIZED 97CNGX2F-AE 140CF.seq (1921 nt.) (SEQ ID NO:61).

FIGS. 38A-38C. FIG. 38A. Wild-type DRCBL-G (854 a.a.) (SEQ ID NO:62). Amino acid sequence underlined is the fusion domain that is deleted in 140CF design and the "W" underlined is the last amino acid at the C-terminus, all amino acids after the "W" are deleted in the 140CF design. FIG. 38B. DRCBL-G 140CF.pep (630 a.a.) (SEQ ID NO:63). Amino acids in bold identify the junction of the deleted fusion cleavage site. FIG. 38C. CODON-OPTIMIZED DRCBL-G 140CF.seq (1921 nt.) (SEQ ID NO:64).

FIGS. 39A and 39B. FIG. 39A. 2003 Con-S Env (SEQ ID NO:65). FIG. 39B. 2003 Con-S Env.seq.opt. (Seq.opt.=codon optimized encoding sequence.) (SEQ ID NO:72)

FIGS. 40A and 40B. FIG. 40A. 2003 M. Group.Anc Env (SEQ ID NO:66). FIG. 40B. 2003 M. Group.anc Env.seq.opt. (Seq.opt.=codon optimized encoding sequence.) (SEQ ID NO:67)

FIGS. 41A and 41B. FIG. 41A. 2003 CON_A1 Env (SEQ ID NO:68). FIG. 41B. 2003 CON_A1 Env.seq.opt. (Seq.opt.=codon optimized encoding sequence.) (SEQ ID NO:70)

FIGS. 42A and 42B. FIG. 42A. 2003 A1.Anc Env (SEQ ID NO:69). FIGS. 42B. 2003 A1.anc Env.seq.opt. (Seq.opt.=codon optimized encoding sequence.) (SEQ ID NO:71)

FIGS. 43A and 43B. FIG. 43A. 2003 CON_A2 Env (SEQ ID NO:73). FIG. 43B. 2003 CON_A2 Env.seq.opt. (Seq.opt.=codon optimized encoding sequence.) (SEQ ID NO:75)

FIGS. 44A and 44B. FIG. 44A. 2003 CON_B Env (SEQ ID NO:74). FIG. 44B. 2003 CON_B Env.seq.opt. (Seq.opt.=codon optimized encoding sequence.) (SEQ ID NO:76)

FIGS. 45A and 45B. FIG. 45A. 2003 B.anc Env (SEQ ID NO:77). FIGS. 45B. 2003 B.anc Env.seq.opt. (Seq.opt.=codon optimized encoding sequence.) (SEQ ID NO:79)

FIGS. 46A and 46B. FIG. 46A. 2003 CON_C Env (SEQ ID NO:78). FIG. 46B. 2003 CON_C Env.seq.opt. (Seq.opt.=codon optimized encoding sequence.) (SEQ ID NO:80)

FIGS. 47A and 47B. FIG. 47A. 2003 C.anc Env (SEQ ID NO:81). FIG. 47B. 2003 C.anc Env.seq.opt. (Seq.opt.=codon optimized encoding sequence.) (SEQ ID NO:83)

FIGS. 48A and 48B. FIG. 48A. 2003 CON_D Env (SEQ ID NO:82). FIG. 48B. 2003 CON_D Env.seq.opt. (Seq.opt.=codon optimized encoding sequence.) (SEQ ID NO:84)

FIGS. 49A and 49B. FIG. 49A. 2003 CON_F1 Env (SEQ ID NO:85). FIG. 49B. 2003 CON_F1 Env.seq.opt. (Seq.opt.=codon optimized encoding sequence.) (SEQ ID NO:87)

FIGS. 50A and 50B. FIG. 50A. 2003 CON_F2 Env (SEQ ID NO:86). FIG. 50B. 2003 CON_F2 Env.seq.opt. (Seq.opt.=codon optimized encoding sequence.) (SEQ ID NO:88)

FIGS. 51A and 51B. FIG. 51A. 2003 CON_G Env (SEQ ID NO:89). FIG. 51B. 2003 CON_G Env.seq.opt. (Seq.opt.=codon optimized encoding sequence.) (SEQ ID NO:91)

FIGS. 52A and 52B. FIG. 52A. 2003 CON_H Env (SEQ ID NO:90). FIG. 52B. 2003 CON_H Env.seq.opt. (Seq.opt.=codon optimized encoding sequence.) (SEQ ID NO:92)

FIGS. 53A and 53B. FIG. 53A. 2003 CON__01_AE Env (SEQ ID NO:93). FIG. 53B. 2003 CON__01_AE Env.seq.opt. (Seq.opt.=codon optimized encoding sequence.) (SEQ ID NO:95)

FIGS. 54A and 54B. FIG. 54A. 2003 CON__02_AG Env (SEQ ID NO:94). FIG. 54B. 2003 CON__02_AG Env.seq.opt. (Seq.opt.=codon optimized encoding sequence.) (SEQ ID NO:96)

FIGS. 55A and 55B. FIG. 55A. 2003 CON__03_AB Env (SEQ ID NO:97. FIG. 55B. 2003 CON __03_AB Env.seq.opt. (Seq.opt.=codon optimized encoding sequence.) (SEQ ID NO:99)

FIGS. 56A and 56B. FIG. 56A. 2003 CON__04_CPX Env (SEQ ID NO:98). FIG. 56B. 2003 CON__04_CPX Env.seq.opt. (Seq.opt.=codon optimized encoding sequence.) (SEQ ID NO:100)

FIGS. 57A and 57B. FIG. 57A. 2003 CON__06_CPX Env (SEQ ID NO:101). FIG. 57B. 2003 CON__06_CPX Env.seq.opt. (Seq.opt.=codon optimized encoding sequence.) (SEQ ID NO:103)

FIGS. 58A and 58B. FIG. 58A. 2003 CON_08_BC Env (SEQ ID NO:102). FIG. 58B. 2003 CON_08_BC Env.seq.opt. (Seq.opt.=codon optimized encoding sequence.) (SEQ ID NO:104)

FIGS. 59A and 59B. FIG. 59A. 2003 CON_10_CD Env (SEQ ID NO:105). FIG. 59B. 2003 CON_10_CD Env.seq.opt. (Seq.opt.=codon optimized encoding sequence.) (SEQ ID NO:107)

FIGS. 60A and 60B. FIG. 60A. 2003 CON_11_CPX Env (SEQ ID NO:106). FIG. 60B. 2003 CON_11_CPX Env.seq.opt. (Seq.opt.=codon optimized encoding sequence.) (SEQ ID NO:108)

FIGS. 61A and 61B. FIG. 61A. 2003 CON_12_BF Env (SEQ ID NO:109). FIG. 61B. 2003 CON_12_BF Env.seq.opt. (Seq.opt.=codon optimized encoding sequence.) (SEQ ID NO:111)

FIGS. 62A and 62B. FIG. 62A. 2003 CON_14_BG Env (SEQ ID NO:110). FIG. 62B. 2003 CON_14_BG Env.seq.opt. (Seq.opt.=codon optimized encoding sequence.) (SEQ ID NO:112)

FIGS. 63A and 63B. FIG. 63A. 2003_CON_S gag.PEP (SEQ ID NO:113). FIG. 63B. 2003_CON_S gag.OPT. (OPT=codon optimized encoding sequence.) (SEQ ID NO:114)

FIGS. 64A and 64B. FIG. 64A. 2003_M.GROUP.anc gag.PEP (SEQ ID NO:115). FIG. 64B. 2003_M.GROUP.anc gag.OPT. (OPT=codon optimized encoding sequence.) (SEQ ID NO:116)

FIGS. 65A-65D. FIG. 65A. 2003_CON_A1 gag.PEP (SEQ ID NO:117). FIG. 65B. 2003_CON_A1 gag.OPT (SEQ ID NO:118). FIG. 65C. 2003_A1.anc gag.PEP (SEQ ID NO:119) . FIG. 65D. 2003_A1.anc gag.OPT (SEQ ID NO:120). (OPT=codon optimized encoding sequence.)

FIGS. 66A and 66B. FIG. 66A. 2003_CON_A2 gag.PEP (SEQ ID NO:121). FIG. 66B. 2003_CON_A2 gag.OPT. (OPT=codon optimized encoding sequence.) (SEQ ID NO:122)

FIGS. 67A-67D. FIG. 67A. 2003_CON_B gag.PEP (SEQ ID NO:123). FIG. 67B. 2003_CON_B gag.OPT (SEQ ID NO:124). FIG. 67C. 2003_B.anc gag.PEP (SEQ ID NO:125). FIG. 67D. 2003_B.anc gag.OPT. (OPT=codon optimized encoding sequence.) (SEQ ID NO:126)

FIGS. 68A-68D. FIG. 68A. 2003_CON_C gag.PEP (SEQ ID NO:127). FIG. 68B. 2003_CON_C gag.OPT (SEQ ID NO:128). FIG. 68C. 2003_C.anc.gag.PEP (SEQ ID NO:129). FIG. 68D. 2003_C.anc.gag.OPT. (OPT=codon optimized encoding sequence.) (SEQ ID NO:130)

FIGS. 69A and 69B. FIG. 69A. 2003_CON_D gag.PEP (SEQ ID NO:131). FIG. 69B. 2003_CON_D gag.OPT. (OPT=codon optimized encoding sequence.) (SEQ ID NO:132)

FIGS. 70A and 70B. FIG. 70A. 2003_CON_F gag.PEP (SEQ ID NO:133). FIG. 70B. 2003_CON_F gag.OPT. (OPT=codon optimized encoding sequence.) (SEQ ID NO:134)

FIGS. 71A and 71B. FIG. 71A. 2003_CON_G gag.PEP (SEQ ID NO:135). FIG. 71B. 2003_CON_G gag.OPT. (OPT=codon optimized encoding sequence.) (SEQ ID NO:136)

FIGS. 72A and 72B. FIG. 72A. 2003_CON_H gag.PEP (SEQ ID NO:137). FIG. 72B. 2003_CON_H gag.OPT. (OPT=codon optimized encoding sequence.) (SEQ ID NO:138)

FIGS. 73A and 73B. FIG. 73A. 2003_CON_K gag.PEP (SEQ ID NO:139). FIG. 73B. 2003_CON_K gag.OPT. (OPT=codon optimized encoding sequence.) (SEQ ID NO:140)

FIGS. 74A and 74B. FIG. 74A. 2003_CON_01_AE gag.PEP (SEQ ID NO:141). FIG. 7B. 2003_CON_01_AE gag.OPT. (OPT=codon optimized encoding sequence.) (SEQ ID NO:142)

FIGS. 75A and 75.B. FIG. 75A. 2003_CON_02_AG gag.PEP (SEQ ID NO:143). FIG. 75B. 2003_CON_02_AG gag.OPT. (OPT=codon optimized encoding sequence.) (SEQ ID NO:144)

FIGS. 76A and 76B. FIG. 76A. 2003_CON_03_ABG gag.PEP (SEQ ID NO:145). FIG. 76B. 2003_CON_03_ABG gag.OPT. (OPT=codon optimized encoding sequence.) (SEQ ID NO:146)

FIGS. 77A and 77B. FIG. 77A. 2003_CON_04_CFX gag.PEP (SEQ ID NO:147). FIG. 77B. 2003_CON_04_CFX gag.OPT. (OPT=codon optimized encoding sequence.) (SEQ ID NO:148)

FIGS. 78A and 78B. FIG. 78A. 2003_CON_06_CPX gag.PEP (SEQ ID NO:150). FIG. 78B. 2003_CON_06_CPX gag.OPT. (OPT=codon optimized encoding sequence.) (SEQ ID NO:151)

FIGS. 79A and 79B. FIG. 79A. 2003_CON_07_BC gag.PEP (SEQ ID NO:152). FIG. 79B. 2003_CON_07_BC gag.OPT. (OPT=codon optimized encoding sequence.) (SEQ ID NO:153)

FIGS. 80A and 80B. FIG. 80A. 2003_CON_08_BC gag.PEP (SEQ ID NO:154). FIG. 80B. 2003_CON_08_BC gag.OPT. (OPT=codon optimized encoding sequence.) (SEQ ID NO:155)

FIGS. 81A and 81B. FIG. 81A. 2003_CON_10_CD gag.PEP (SEQ ID NO:156). FIG. 81B. 2003_CON_10_CD gag.OPT. (OPT=codon optimized encoding sequence.) (SEQ ID NO:157)

FIGS. 82A and 82B. FIG. 82A. 2003_CON_11_CPX gag.PEP (SEQ ID NO:158). FIG. 82B. 2003_CON_11_CPX gag.OPT. (OPT=codon optimized encoding sequence.) (SEQ ID NO:159)

FIGS. 83A and 83B. FIG. 83A. 2003_CON_12_BF.gag.PEP (SEQ ID NO:160). FIG. 83B. 2003_CON_12_BF.gag.OPT. (OPT=codon optimized encoding sequence.) (SEQ ID NO:161)

FIGS. 84A and 84B. FIG. 84A. 2003_CON_14_BG gag.PEP (SEQ ID NO:162). FIG. 84B. 2003_CON_14_BG gag.OPT. (OPT=codon optimized encoding sequence.) (SEQ ID NO:163)

FIGS. 85A and 85B. FIG. 85A. 2003_CONS nef.PEP (SEQ ID NO:164). FIG. 85B.

Figures 2A, 2B, 2C, 2D:
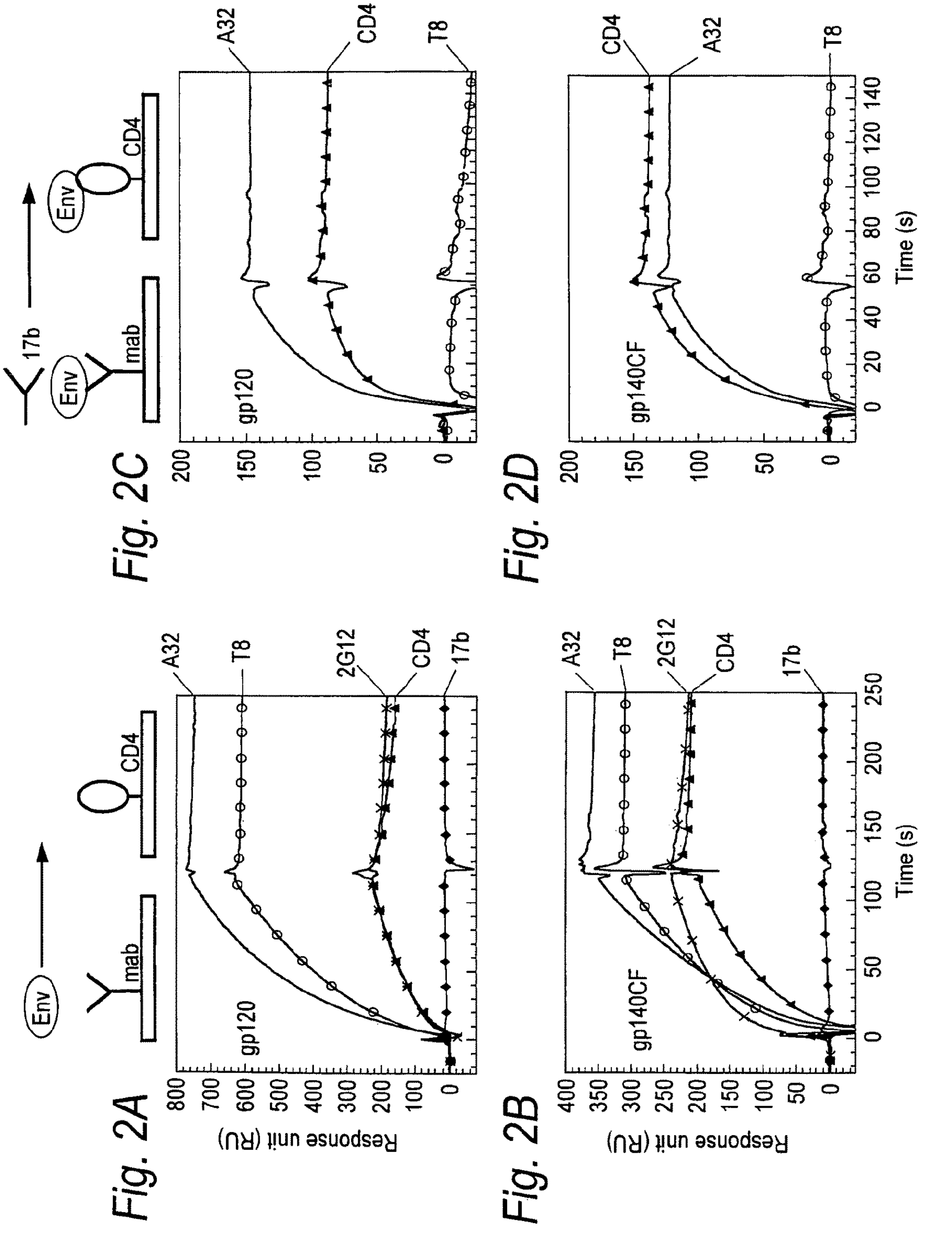
FIGS. 2A-2E. Binding of CON6 gp120 gp140 CF to soluble CD4 (sCD4) and anti-Env mAbs.

2003_CONS nef.OPT. (OPT=codon optimized encoding sequence.) (SEQ ID NO:165)

FIGS. 86A and 86B. FIG. 86A. 2003_M GROUP.anc nef.PEP (SEQ ID NO:166). FIG. 86B. 2003_M GROUP.anc.nef.OPT. (OPT=codon optimized encoding sequence.) (SEQ ID NO:167)

FIGS. 87A and 87B. FIG. 87A. 2003_CON_A nef.PEP (SEQ ID NO:168). FIG. 87B. 2003_CON_A nef.OPT. (OPT=codon optimized encoding sequence.) (SEQ ID NO:169)

FIGS. 88A-88D. FIG. 88A. 2003_CON_A1 nef.PEP (SEQ ID NO:170). FIG. 88B. 2003_CON_A1 nef.OPT (SEQ ID NO:171). FIG. 88C. 2003 A1.anc nef.PEP (SEQ ID NO:172). FIG. 88D. 2003_A1.anc nef.OPT. (OPT=codon optimized encoding sequence.) (SEQ ID NO:173)

FIGS. 89A and 89B. FIG. 89A. 2003_CON_A2 nef.PEP (SEQ ID NO:174). FIG. 89B. 2003_CON_A2 nef.OPT. (OPT=codon optimized encoding sequence.) (SEQ ID NO:175)

FIGS. 90A-90D. FIG. 90A. 2003_CON_B nef.PEP (SEQ ID NO:176). FIG. 90B. 2003_CON-B nef.OPT (SEQ ID NO:177). FIG. 90C. 2003_B.anc nef.PEP (SEQ ID NO:178). FIG. 90D. 2003_B.anc nef.OPT. (OPT=codon optimized encoding sequence.) (SEQ ID NO:179)

FIGS. 91A and 91B. FIG. 91A. 2003_CON__02_AG nef. PEP (SEQ ID NO:180). FIG. 91B. 2003_CON__02_AG nef.OPT. (OPT=codon optimized encoding sequence.) (SEQ ID NO:181)

FIGS. 92A-92D. FIG. 92A. 2003_CON_C nef.PEP (SEQ ID NO:182). FIG. 92B. 2003_CON_C nef.OPT (SEQ ID NO:183). FIG. 92C. 2003_C.anc nef.PEP (SEQ ID NO:184).

FIG. 92D. 2003_C.anc nef.OPT. (OPT=codon optimized encoding sequence.) (SEQ ID NO:185)

FIGS. 93A and 93B. FIG. 93A. 2003_CON_D nef.PEP (SEQ ID NO:186). FIG. 93B. 2003_CON_D nef.OPT. (OPT=codon optimized encoding sequence.) (SEQ ID NO:187)

FIGS. 94A and 94B. FIG. 94A. 2003_CON_F1 nef.PEP (SEQ ID NO:188). FIG. 94B. 2003_CON_F1 nef.OPT. (OPT=codon optimized encoding sequence.) (SEQ ID NO:189)

FIGS. 95A and 95B. FIG. 95A. 2003_CON_F2 nef.PEP (SEQ ID NO:190). FIG. 95B. 2003_CON_$_{l\ F}$2 nef.OPT. (OPT=codon optimized encoding sequence.) (SEQ ID NO:191)

FIGS. 96A and 96B. FIG. 96A. 2003_CON_G nef.PEP (SEQ ID NO:192). FIG. 96B. 2003_CON_G nef.OPT. (OPT=codon optimized encoding sequence.) (SEQ ID NO:193)

FIGS. 97A and 97B. FIG. 97A. 2003_CON_H nef.PEP (SEQ ID NO:194). FIG. 97B. 2003_CON_H nef.OPT. (OPT=codon optimized encoding sequence.) (SEQ ID NO:195)

FIGS. 98A and 98B. FIG. 98A. 2003_CON__01_AE nef. PEP (SEQ ID NO:196). FIG. 98B. 2003_CON__01_AE nef.OPT. (OPT=codon optimized encoding sequence.) (SEQ ID NO:197)

FIGS. 99A and 99B. FIG. 99A. 2003_CON__03_AE nef. PEP (SEQ ID NO:198). FIG. 99B. 2003_CON__03_AE nef.OPT. (OPT=codon optimized encoding sequence.) (SEQ ID NO:199)

FIGS. 100A and 100B. FIG. 100A. 2003_CON__04_CFX nef.PEP (SEQ ID NO:200). FIG. 100B. 2003_CON__04_CFX nef.OPT. (OPT=codon optimized encoding sequence.) (SEQ ID NO:201)

FIGS. 101A and 101B. FIG. 101A. 2003_CON__06_CFX nef.PEP (SEQ ID NO:202). FIG. 101B. 2003_CON__06_CFX nef.OPT. (OPT=codon optimized encoding sequence.) (SEQ ID NO:203)

FIGS. 102A and 102B. FIG. 102A. 2003_CON__08_BC nef.PEP (SEQ ID NO:204). FIG. 102B. 2003_CON__08_BC nef.OPT. (OPT=codon optimized encoding sequence.) (SEQ ID NO:205)

FIGS. 103A and 103B. FIG. 103A. 2003_CON __10_CD nef.PEP (SEQ ID NO:206). FIG. 103B. 2003_CON__10_CD nef.OPT. (OPT=codon optimized encoding sequence.) (SEQ ID NO:207)

FIGS. 104A and 104B. FIG. 104A. 2003_CON__11 _CFX nef.PEP (SEQ ID NO:208). FIG. 104B. 2003_CON__11_CFX nef.OPT. (OPT=codon optimized encoding sequence.) (SEQ ID NO:209)

FIGS. 105A and 105B. FIG. 105A. 2003_CON__12_BF nef.PEP (SEQ ID NO:210). FIG. 105B. 2003_CON__12_BF nef.OPT. (OPT=codon optimized encoding sequence.) (SEQ ID NO:211)

FIGS. 106A and 106B. FIG. 106A. 2003_CON__14_BG nef.PEP (SEQ ID NO:212). FIG. 106B. 2003_CON__14_BG nef.OPT. (OPT=codon optimized encoding sequence.) (SEQ ID NO:213)

FIGS. 107A and 107B. FIG. 107A. 2003_CON_S pol.PEP (SEQ ID NO:214). FIG. 107B. 2003_CON_S pol.OPT. (OPT=codon optimized encoding sequence.) (SEQ ID NO:215)

FIGS. 108A and 108B. FIG. 108A. 2003_M GROUP anc pol.PEP (SEQ ID NO:216). FIG. 108B. 2003_M.GROUP anc pol.OPT. (OPT=codon optimized encoding sequence.) (SEQ ID NO:218)

FIGS. 109A-109D. FIG. 109A. 2003_CON_A1 pol.PEP (SEQ ID NO:217). FIG. 109B. 2003_CON_A1 pol.OPT (SEQ ID NO:219). FIG. 109C. 2003_A1.anc pol.PEP (SEQ ID NO:220). FIG. 109D. 2003_A1.anc pol.OPT (SEQ ID NO:221). (OPT=codon optimized encoding sequence.)

FIGS. 110A and 110B. FIG. 110A. 2003_CON_A2 pol.PEP (SEQ ID NO:222). FIG. 110B. 2003_CON_A2 pol. OPT. (OPT=codon optimized encoding sequence.) (SEQ ID NO:224)

FIGS. 111A-111D. FIG. 111A. 2003_CON_B pol.PEP (SEQ ID NO:223). FIG. 111B. 2003_CON_B pol.OPT (SEQ ID NO:225). FIG. 111C. 2003_B.anc pol.PEP (SEQ ID NO:226). FIG. 111D. 2003_B.anc pol.OPT (SEQ ID NO:227). (OPT=codon optimized encoding sequence.)

FIGS. 112A-112D. FIG. 112A. 2003_CON_C pol.PEP (SEQ ID NO:228). FIG. 112B. 2003_CON_C pol.OPT (SEQ ID NO:229). FIG. 112C. 2003_C.anc pol.PEP (SEQ ID NO:230). FIG. 112D. 2003_C.anc pol.OPT. (OPT=codon optimized encoding sequence.) (SEQ ID NO:231)

FIGS. 113A and 113B. FIG. 113A. 2003_CON_D pol.PEP (SEQ ID NO:232). FIG. 113B. 2003_CON_D pol.OPT. (OPT=codon optimized encoding sequence.) (SEQ ID NO:224)

FIGS. 114A and 114B. FIG. 114A. 2003_CON_F1 pol.PEP (SEQ ID NO:233). FIG. 114B. 2003_CON_F1 pol. OPT. (OPT=codon optimized encoding sequence.) (SEQ ID NO:235)

FIGS. 115A and 115B. FIG. 115A. 2003_CON_F2 pol.PEP (SEQ ID NO:236). FIG. 115B. 2003_CON_F2 pol. OPT. (OPT=codon optimized encoding sequence.) (SEQ ID NO:238)

FIGS. 116A and 116B. FIG. 116A. 2003_CON_G pol.PEP (SEQ ID NO:237). FIG. 116B. 2003_CON_G pol.OPT. (OPT=codon optimized encoding sequence.) (SEQ ID NO:239)

FIGS. 117A and 117B. FIG. 117A. 2003_CON_H pol.PEP (SEQ ID NO:240). FIG. 117B. 2003_CON_H pol.OPT. (OPT=codon optimized encoding sequence.) (SEQ ID NO:242)

FIGS. 118A and 118B. FIG. 118A. 2003_CON__01_AE pol.PEP (SEQ ID NO:241). FIG. 118B. 2003_CON__01_AE pol.OPT. (OPT=codon optimized encoding sequence.) (SEQ ID NO:243)

FIGS. 119A and 119B. FIG. 119A. 2003_CON__02_AG pol.PEP (SEQ ID NO:244). FIG. 119B. 2003_CON__02_AG pol.OPT. (OPT=codon optimized encoding sequence.) (SEQ ID NO:246)

FIGS. 120A and 120B. FIG. 120A. 2003_CON__03_AB pol.PEP (SEQ ID NO:245). FIG. 120B. 2003_CON__03_AB pol.OPT. (OPT=codon optimized encoding sequence.) (SEQ ID NO:247)

FIGS. 121A and 121B. FIG. 121A. 2003_CON__04_CPX pol.PEP (SEQ ID NO:248). FIG. 121B. 2003_CON__04_CPX pol.OPT. (OPT=codon optimized encoding sequence.) (SEQ ID NO:250)

FIGS. 122A and 122B. FIG. 122A. 2003_CON_06_CPX pol.PEP (SEQ ID NO:249). FIG. 122B. 2003_CON_06_CPX pol.OPT. (OPT=codon optimized encoding sequence.) (SEQ ID NO:251)

FIGS. 123A and 123B. FIG. 123A. 2003_CON_08_BC pol.PEP (SEQ ID NO:252). FIG. 123B. 2003_CON_08_BC pol.OPT. (OPT=codon optimized encoding sequence.) (SEQ ID NO:254)

FIGS. 124A and 124B. FIG. 124A. 2003_CON_10_CD pol.PEP (SEQ ID NO:253). FIG. 124B. 2003_CON_10_CD pol.OPT. (OPT=codon optimized encoding sequence.) (SEQ ID NO:255)

FIGS. 125A and 125B. FIG. 125A. 2003_CON_11_CPX pol.PEP (SEQ ID NO:256). FIG. 125B. 2003_CON_11_CPX pol.OPT. (OPT=codon optimized encoding sequence.) (SEQ ID NO:258)

FIGS. 126A and 126B. FIG. 126A. 2003_CON_12_BF pol.PEP (SEQ ID NO:257). FIG. 126B. 2003_CON_12_BF pol.OPT. (OPT=codon optimized encoding sequence.) (SEQ ID NO:259)

FIGS. 127A and 127B. FIG. 127A. 2003_CON_14_BG pol.PEP (SEQ ID NO:260). FIG. 127B. 2003_CON_14_BG pol.OPT. (OPT=codon optimized encoding sequence.) (SEQ ID NO:261)

Figure 128:
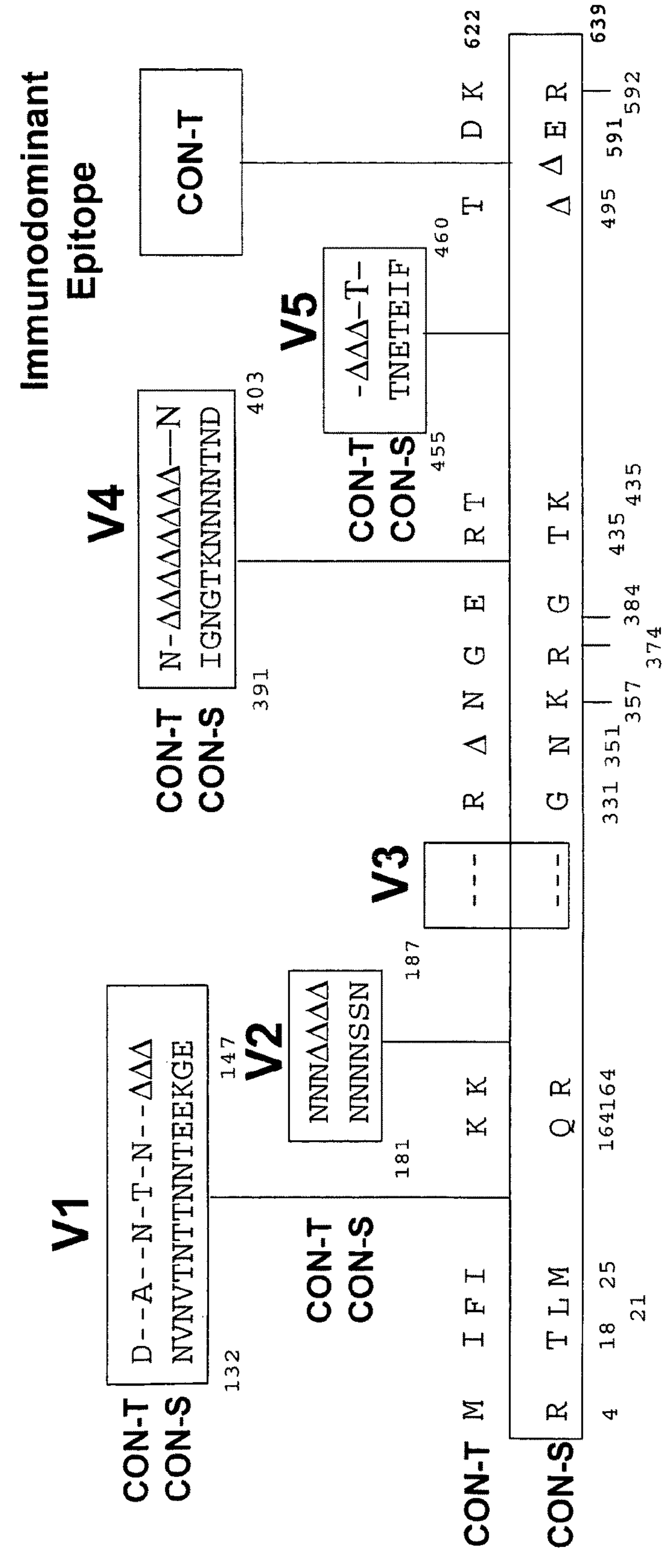
Figure 178:
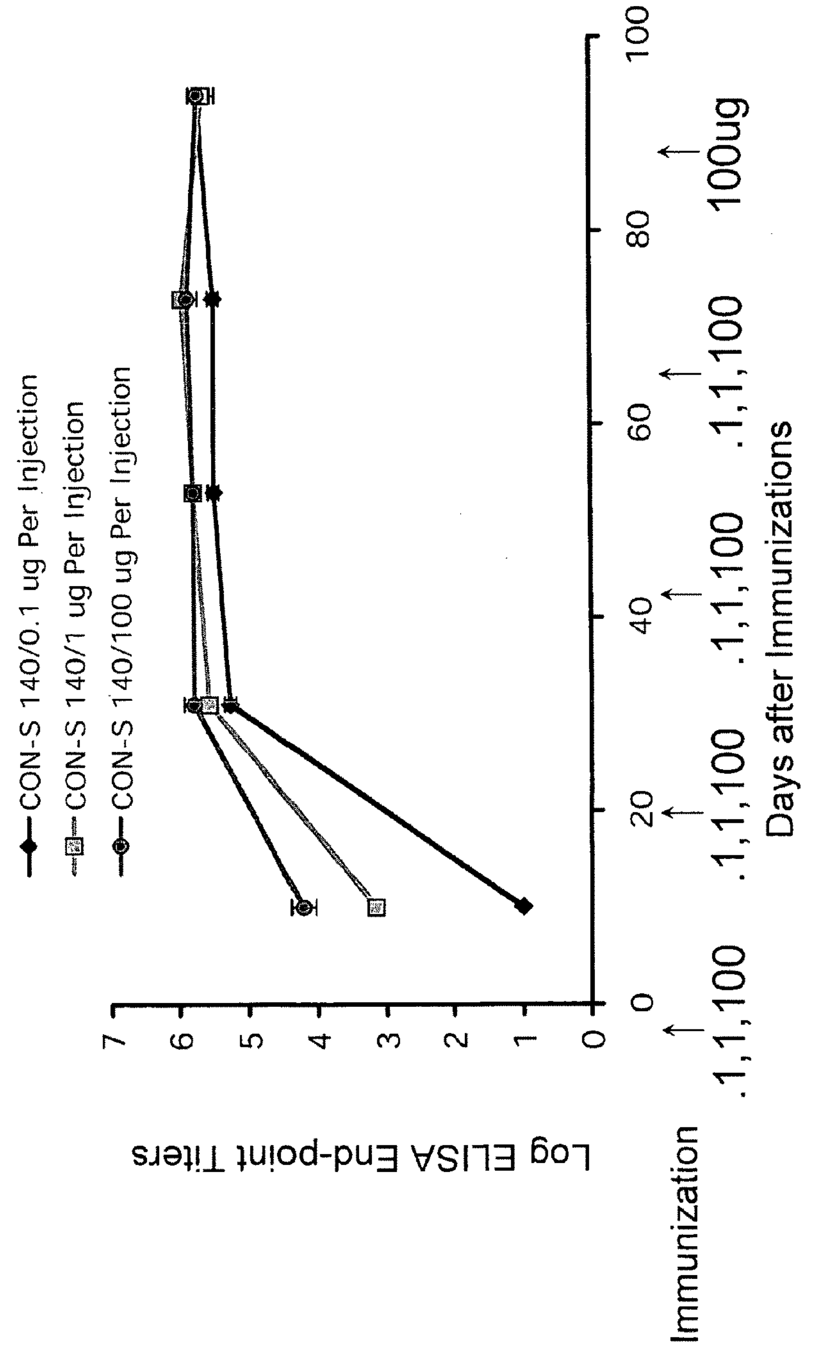

FIG. 128. Wildtype vs consensus env oligomers as immunogens. Sheet 3: residues 132-147 of SEQ ID NO:30, residues 181-187 of SEQ ID NO:30, residues 391-403 of SEQ ID NO:30 and residues 454-460 of SEQ ID NO:30. Sheet 24: SEQ ID NO:322.

DETAILED DESCRIPTION OF THE INVENTION

The present invention relates to an immunogen that induces antibodies that neutralize a wide spectrum of human immunodeficiency virus (HIV) primary isolates and/or that induces a T cell response. The immunogen comprises at least one consensus or ancestral immunogen (e.g., Env, Gag, Nef or Pol), or portion or variant thereof. The invention also relates to nucleic acid sequences encoding the consensus or ancestral immunogen, or portion or variant thereof. The invention further relates to methods of using both the immunogen and the encoding sequences. While the invention is described in detail with reference to specific consensus and ancestral immunogens (for example, to a group M consensus Env), it will be appreciated that the approach described herein can be used to generate a variety of consensus or ancestral immunogens (for example, envelopes for other HIV-1 groups (e.g., N and O)).

In accordance with one embodiment of the invention, a consensus env gene can be constructed by generating consensus sequences of env genes for each subtype of a particular HIV-1 group (group M being classified into subtypes A-D, F-H, J an K), for example, from sequences in the Los Alamos HIV Sequence Database (using, for example, MASE (Multiple Aligned Sequence Editor)). A consensus sequence of all subtype consensuses can then be generated to avoid heavily sequenced subtypes (Gaschen et al, Science 296:2354-2360 (2002), Korber et al, Science 288:1789-1796 (2000)). In the case of the group M consensus env gene described in Example 1 (designated CON6), five highly variable regions from a CRF08_BC recombinant strain (98CN006) (V1, V2, V4, V5 and a region in cytoplasmic domain of gp41) are used to fill in the missing regions in the sequence (see, however, corresponding regions for Con-S). For high levels of expression, the codons of consensus or ancestral genes can be optimized based on codon usage for highly expressed human genes (Haas et al, Curr. Biol. 6:315-324 (2000), Andre et al, J. Virol. 72:1497-1503 (1998)).

With the Year 1999 consensus group M env gene, CON6, it has been possible to demonstrate induction of superior T cell responses by CON6 versus wild-type B and C env by the number of ELISPOT γ-interferon spleen spot forming cells and the number of epitopes recognized in two strains of mice (Tables 1 and 2 show the data in BALB/c mice). The ability of CON6 Env protein to induce neutralizing antibodies to HIV-1 primary isolates has been compared to that of several subtype B Env. The target of neutralizing antibodies induced by CON6 includes several non-B HIV-1 strains.

TABLE 1

T cell epitope mapping of CON6, JRFL and 96ZM651 Env immunogen in BALB/c mice

| | | Immunogen | | | T cell |
|---|---|---|---|---|---|
| | Peptide | CON6 | JRFL (B) | 96ZM651 (C) | response |
| | **CON 6 (group M consensus)** | | | | |
| 16 | DTEVHNVWATHACVP | + | | + | CD4 |
| 48 | KNSSEYYRLINCNTS | + | | + | CD4 |
| 49 | EYYRLINCNTSAITQ | | | | |
| 53 | CPKVSFEPIPIHYCA | + | | | CD4 |
| 54 | SFEPIPIHYCAPAGF | | | | |
| 62 | NVSTVQCTHGIKPVV | + | | | CD4 |
| 104 | ETITLPCRIKQIINM | + | | | CD8 |
| 105 | LPCRIKQIINMWQGV | | | | |
| 130 | GIVQQQSNLLRAIEA | + | | | CD4 |
| 131 | VQQSNLLRAIEAQQHL | | | | |
| 134 | AQQHLLQLTVWGIKQLQ | + | | | CD4 |
| 135 | LQLTVWGIKQLQARVL | | | | |
| | **Subtype B (MN)** | | | | |
| 6223 | AKAYDTEVHNVWATQ | + | | | CD4 |
| 6224 | DTEVHNVWATQACVP | | | | |
| 6261 | ACPKISFEPIPIHYC | + | | | CD4 |
| 6262 | ISFEPIPIHYCAPAG | | | | |
| 6286 | RKRIHIGPGRAFYTT | | + | | CD8 |
| 6287 | HIGPGRAFYTTKNII | | | | |
| 6346 | IVQQQNNLLRAIEAQ | + | | | CD4 |
| 6347 | QNNLLRAIEAQQHML | | | | |
| | **Subtype C (Chn19)** | | | | |
| 4834 | VPVWKEAKTTLFCASDAKSY | | | + | CD4 |
| 4836 | GKEVHNVWATHACVPTDPNP | + | | + | CD4 |
| 4848 | SSENSSEYYRLINCNTSAIT | + | | + | CD4 |
| 4854 | STVQCTHGIKPVVSTQLLLN | + | | | CD4 |
| 4884 | QQSNLLRAIEAQQHLLQLTV | + | | | CD4 |
| 4885 | AQQHLLQLTVWGIKQLQTRV | + | | | CD4 |

TABLE 2

T cell epitope mapping of CON6.gp120 immunogen in C57BL/6 mice. Table discloses SEQ ID NOS: 288-304, respectively, in order of appearance.

| Peptide | Peptide sequence | T cell response |
|---|---|---|
| CON 6 (consensus) | | |
| 2 | GIQRNCQHLWRWGTM | CD8 |
| 3 | NCQHLWRWGTMILGM | |
| 16 | DTEVHNVWATHACVP | CD4 |
| 53 | CPKVSFEPIPIHYCA | CD4 |
| 97 | FYCNTSGLFNSTWMF | CD8 |
| 99 | FNSTWMFNGTYMFNG | CD8 |
| Subtype B (MN) | | |
| 6210 | GIRRNYQHWWGWGTM | CD8 |
| 6211 | NYQHWWGWGTMLLGL | |
| 6232 | NMWKNNMVEQMHEDI | CD4 |
| 6262 | ISFEPIPIHYCAPAG | CD4 |
| 6290 | NIIGTIRQAHCNISR | CD4 |
| 6291 | TIRQAHCNISRAKWN | |

TABLE 2-continued

T cell epitope mapping of CON6.gp120 immunogen in C57BL/6 mice. Table discloses SEQ ID NOS: 288-304, respectively, in order of appearance.

| Peptide | Peptide sequence | T cell response |
|---|---|---|
| Subtype C (Chn 19) | | |
| 4830 | MRVTGIRKNYQHLWRWGTML | CD8 |
| 5446 | RWGTMLLGMLMICSAAEN | CD8 |
| 4836 | GKEVHNVWATHACVPTDPNP | CD4 |
| 4862 | GDIRQAHCNISKDKWNETLQ | CD4 |
| 4888 | LLGIWGCSGKLICTTTVPWN | CD8 |

Figure 27:
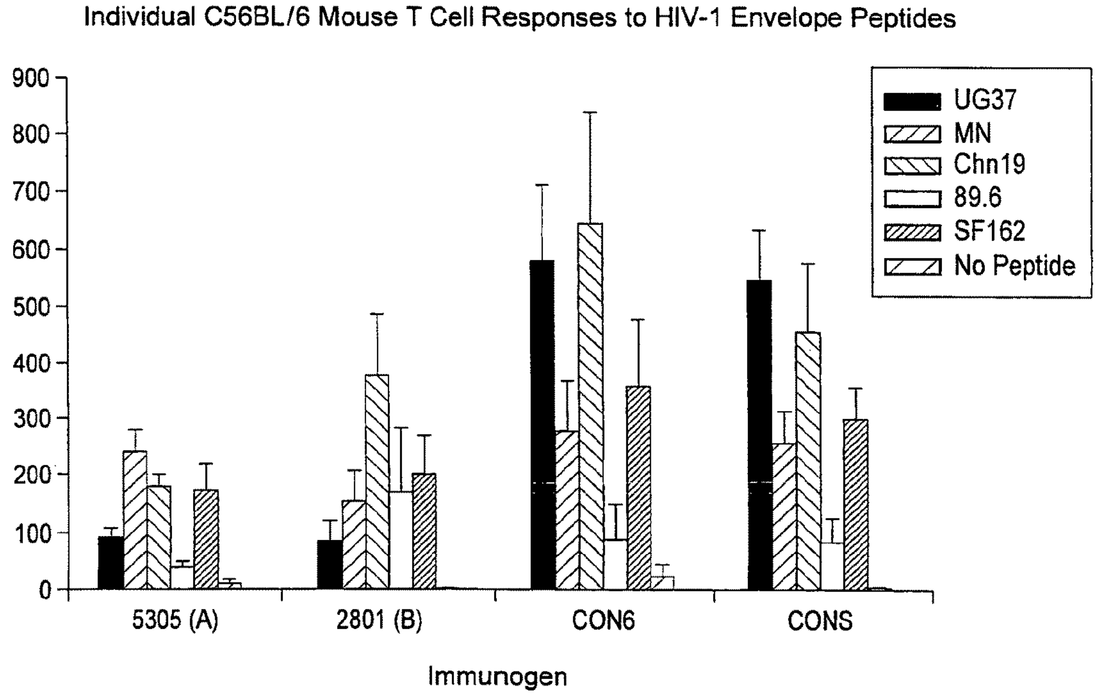
FIG. 27. Individual C57BL/6 mouse T cell responses to HIV-1 envelope peptides. Comparative immunogenicity of CON6 gp140CFI and Con-S gp140CFI in C57BL/C mice. Mice were immunized with either HIV5305 (Subtype A), 2801 (Subtype B), CON6 or Con-S Envelope genes in DNA prime, rVV boost regimens, 5 mice per group. Spleen cells were assayed for IFN-γ spot-forming cells 10 days after rVV boost, using mixtures of overlapping peptides from Envs of HIV-1 UG37(A), MN(B), Ch19(C), 89.6(B) SF162(B) or no peptide negative control.

For the Year 2000 consensus group M env gene, Con-S, the Con-S envelope has been shown to be as immunogenic as the CON6 envelope gene in T cell γ interferon ELISPOT assays in two strains of mice (the data for C57BL/6 are shown in FIG. 27). Furthermore, in comparing CON6 and Con-S gp140 Envs as protein immunogens for antibody in guinea pigs (Table 3), both gp140 Envs were found to induce antibodies that neutralized subtype B primary isolates. However, Con-S gp140 also induced robust neutralization of the subtype C isolates TV-1 and DU 123 as well as one subtype A HIV-1 primary isolate, while CON6 did not.

TABLE 3

Ability of Group M Consensus CON6 and Con-S Envs to Induce Neutralization of HIV-1 Primary Isolates

| HIV-1 Isolate | CON6 gp140CF | | | | CON6 gp140 CFI | | | | CONS gp140 CFI | | | |
|---|---|---|---|---|---|---|---|---|---|---|---|---|
| | Guinea Pig Number | | | | | | | | | | | |
| (Subtype) | 770 | 771 | 772 | 775 | 781 | 783 | 784 | 786 | 776 | 777 | 778 | 780 |
| BX08(B) | 520 | 257 | 428 | 189 | 218 | 164 | >540 | 199 | >540 | >540 | >540 | >540 |
| QH0692(B) | 46 | 55 | 58 | 77 | <20 | 91 | 100 | 76 | 109 | <20 | <20 | <20 |
| SS1196(B) | 398 | 306 | 284 | 222 | 431 | 242 | >540 | 351 | >540 | 296 | >540 | >540 |
| JRLFL(B) | <20 | <20 | <20 | <20 | <20 | 169 | <20 | <20 | <20 | <20 | <20 | <20 |
| BG1168(B) | <20 | <20 | <20 | <20 | <20 | <20 | <20 | <20 | <20 | <20 | <20 | <20 |
| 3988(B) | <20 | <20 | <20 | <20 | <20 | <20 | <20 | <20 | <20 | <20 | <20 | <20 |
| 6101(B) | <20 | <20 | <20 | <20 | <20 | <20 | <20 | <20 | <20 | <20 | <20 | <20 |
| TV-1(C) | <20 | <20 | <20 | <20 | <20 | <20 | <20 | <20 | 356 | 439 | >540 | >54 |
| DU123(C) | <20 | <20 | 71 | 74 | <20 | 72 | <20 | <20 | 176 | 329 | 387 | 378 |
| DU172(C) | <20 | <20 | 96 | 64 | <20 | <20 | <20 | <20 | <20 | 235 | <20 | 213 |
| ZM18108.6(C) | ND | ND | ND | ND | <20 | <20 | <20 | <20 | 84 | 61 | 86 | 43 |
| ZM14654.7(C) | ND | ND | ND | ND | <20 | <20 | <20 | <20 | <20 | <20 | 30 | <20 |
| DU151(C) | <20 | <20 | <20 | <20 | <20 | <20 | <20 | <20 | <20 | <20 | <20 | <20 |
| DU422(C) | <20 | <20 | <20 | <20 | <20 | <20 | <20 | <20 | <20 | <20 | <20 | <20 |
| DU156(C) | <20 | <20 | <20 | <20 | <20 | <20 | <20 | <20 | <20 | <20 | <20 | <20 |
| 92RWO20(A) | <20 | <20 | <20 | <20 | <20 | <20 | <20 | <20 | 116 | 204 | 95 | 177 |
| 92UG037(A) | <20 | <20 | 30 | <20 | <20 | 44 | <20 | <20 | <20 | <20 | <20 | ≦2 |

≠50% Neutralization titers after 4th or 5th immunizations

Year 2000 Con-S 140CFI.ENV sequence is shown in FIG. 26A. Gp140 CFI refers to an HIV-1 envelope design in which the cleavage-site is deleted (c), the fusion-site is deleted (F) and the gp41 immunodominant region is deleted (I), in addition to the deletion of transmembrane and cytoplasmic domains. The codon-optimized Year 2000 Con-S 140 CFI sequence is shown in FIG. 26B.

As the next iteration of consensus immunogens, and in recognition of the fact that a practical HIV-1 immunogen can be a polyvalent mixture of either several subtype consensus genes, a mixture of subtype and consensus genes, or a mixture of centralized genes and wild type genes, a series of 11 subtype consensus, and wild type genes have been designed from subtypes A, B, C, CRF AE01, and G as well as a group M consensus gene from Year 2003 Los Alamos National Database sequences. The wild type sequences were chosen either because they were known to come from early transmitted HIV-1 strains (those strains most likely to be necessary to be protected against by a vaccine) or because they were the most recently submitted strains in the database of that subtype. These nucleotide and amino acid sequences are shown in FIGS. 28-38 (for all 140CF designs shown, 140CF gene can be flanked with the 5' sequence "TTCAGTCGACGGCCACC" (SEQ ID NO:305) that contains a Kozak sequence (GCCACCATGG/A) (SEQ ID NO:306) and SalI site and 3' sequence of TAAAGATCTTACAA (SEQ ID NO:307) containing stop codon and BglII site). Shown in FIGS. 39-62 are 2003 centralized (consensus and ancestral) HIV-1 envelope proteins and the codon optimized gene sequences.

Major differences between CON6 gp140 (which does not neutralize non-Glade B HIV strains) and. Con-S gp140 (which does induce antibodies that neutralize non-Glade B HIV strains) are in Con-S V1, V2, V4 and V5 regions. For clade B strains, peptides of the V3 region can induce neutralizing antibodies (Haynes et al, J. Immunol. 151:1646-1653 (1993)). Thus, construction of Th-V1, Th-V2, Th-V4, Th-V5 peptides can be expected to give rise to the desired broadly reactive anti-non-clade B neutralizing antibodies. Therefore, the Th-V peptides set forth in Table 4 are contemplated for use as a peptide immunogen(s) derived from Con-S gp140. The gag Th determinant (GTH, Table 4) or any homologous GTH sequence in other HIV strains, can be used to promote immunogenicity and the C4 region of HIV gp120 can be used as well (KQIINMWQVVGKAMYA) (SEQ ID NO:308) or any homologous C4 sequence from other HIV strains (Haynes et al, J. Immunol. 151:1646-1653 (1993)). Con-S V1, V2, V4, V5 peptides with an N-terminal helper determinant can be used singly or together, when formulated in a suitable adjuvant such as Corixa's RC529 (Baldridge et al, J. Endotoxin Res. 8:453-458 (2002)), to induce broadly cross reactive neutralizing antibodies to non-clade B isolates.

It will be appreciated that the invention includes portions and variants of the sequences specifically disclosed herein. For example, forms of codon optimized consensus encoding sequences can be constructed as gp140CF, gp140 CFI, gp120 or gp160 forms with either gp120/41 cleaved or uncleaved. For example, and as regards the consensus and ancestral envelope sequences, the invention encompasses envelope sequences devoid of V3. Alternatively, V3 sequences can be selected from preferred sequences, for example, those described in U.S. application Ser. No. 10/431,596 and U.S. Provisional Application No. 60/471,327. In addition, an optimal immunogen for breadth of response can include mixtures of group M consensus gag, pol, nef and env encoding sequences, and as well as consist of mixtures of subtype consensus or ancestral encoding sequences for gag, pol, nef and env HIV genes. For dealing with regional differences in virus strains, an efficacious mixture can include mixtures of consensus/ancestral and wild type encoding sequences.

A consensus or ancestral envelope of the invention can be been "activated" to expose intermediate conformations of neutralization epitopes that normally are only transiently or less well exposed on the surface of the HIV virion. The immunogen can be a "frozen" triggered form of a consensus or ancestral envelope that makes available specific epitopes for presentation to B lymphocytes. The result of this epitope presentation is the production of antibodies that broadly neutralize HIV. (Attention is directed to WO 02/024149 and to the activated/triggered envelopes described therein.)

The concept of a fusion intermediate immunogen is consistent with observations that the gp41 HR-2 region peptide, DP178, can capture an uncoiled conformation of gp41 (Furata et al, Nature Struct. Biol. 5:276 (1998)), and that formalin-fixed HIV-infected cells can generate broadly neutralizing antibodies (LaCasse et al, Science 283:357 (1997)). Recently a monoclonal antibody against the coiled-coil region bound to a conformational determinant of gp41 in HR1 and HR2 regions of the coiled-coil gp41 structure, but did not neutralize HIV (Jiang et al, J. Virol. 10213 (1998)). However, this latter study proved that the coiled-coil region is available for antibody to bind if the correct antibody is generated.

The immunogen of one aspect of the invention comprises a consensus or ancestral envelope either in soluble form or anchored, for example, in cell vesicles or in liposomes containing translipid bilayer envelope. To make a more native

TABLE 4

| (SEQ ID NOS: 309-318, respectively, in order of appearance) | |
|---|---|
| 1) GTH Con-S V1 132-150 | YKRWIILGLNKIVRMYTNVNVTNTTNNTEEKGEIKN |
| 2) GTH Con-S V2 157-189 | YKRWIILGLNKIVRMYTEIRDKKQKVYALFYRLDVVPIDDNNNNSSNYR |
| 3) GTH Con-S V3 294-315 | YKRWIILGLNKIVRMYTRPNNNTRKSIRIGPGQAFYAT |
| 4) GTH Con-S V4 381-408 | YKRWIILGLNKIVRMYNTSGLFNSTWIGNGTKNNNNTNDTITLP |
| 5) GTH Con-S V5 447-466 | YKRWIILGLNKIVRMYRDGGNNNTNETEIFRPGGGD |
| 6) GTH Con-6 V1 132-150 | YKRWIILGLNKIVRMYNVRNVSSNGTETDNEEIKN |
| 7) GTH Con-6 V2 157-196 | YKRWIILGLNKIVRMYTELRDKKQKVYALFYRLDVVPIDDKNSSEISGKNSSEYYR |
| 8) GTH-Con6 V3 301-322 | YKRWIILGLNKIVRMYTRPNNNTRKSIHIGPGQAFYAT |
| 9) GTH Con-6 V4 388-418 | YKRWIILGLNKIVRMYNTSGLFNSTWMFNGTYMFNGTKDNSETITLP |
| 10 GTH Con 6 V5 457-477 | YKRWIILGLNKIVRMYRDGGNNSNKNKTETFRPGGGD |

envelope, gp140 or gp160 consensus or ancestral sequences can be configured in lipid bilayers for native trimeric envelope formation. Alternatively, triggered gp160 in aldrithio 1-2 inactivated HIV-1 virions can be used as an immunogen. The gp160 can also exist as a recombinant protein either as gp160 or gp140 (gp140 is gp160 with the transmembrane region and possibly other gp41 regions deleted). Bound to gp160 or gp140 can be recombinant CCR5 or CXCR4 co-receptor proteins (or their extracellular domain peptide or protein fragments) or antibodies or other ligands that bind to the CXCR4 or CCR5 binding site on gp120, and/or soluble CD4, or antibodies or other ligands that mimic the binding actions of CD4. Alternatively, vesicles or liposomes containing CD4, CCR5 (or CXCR4), or soluble CD4 and peptides reflective of CCR5 or CXCR4 gp120 binding sites. Alternatively, an optimal CCR5 peptide ligand can be a peptide from the N-terminus of CCR5 wherein specific tyrosines are sulfated (Bormier et al, Proc. Natl. Acad. Sci. USA 97:5762 (2001)). The triggered immunogen may not need to be bound to a membrane but may exist and be triggered in solution. Alternatively, soluble CD4 (sCD4) can be replaced by an envelope (gp140 or gp160) triggered by CD4 peptide mimetopes (Vitra et al, Proc. Natl. Acad. Sci. USA 96:1301 (1999)). Other HIV co-receptor molecules that "trigger" the gp160 or gp140 to undergo changes associated with a structure of gp160 that induces cell fusion can also be used. Ligation of soluble HIV gp140 primary isolate HIV 89.6 envelope with soluble CD4 (sCD4) induced conformational changes in gp41.

In one embodiment, the invention relates to an immunogen that has the characteristics of a receptor (CD4)-ligated consensus or ancestral envelope with CCR5 binding region exposed but unlike CD4-ligated proteins that have the CD4 binding site blocked, this immunogen has the CD4 binding site exposed (open). Moreover, this immunogen can be devoid of host CD4, which avoids the production of potentially harmful anti-CD4 antibodies upon administration to a host.

The immunogen can comprise consensus or ancestral envelope ligated with a ligand that binds to a site on gp120 recognized by an A32 monoclonal antibodies (mab) (Wyatt et al, J. Virol. 69:5723 (1995), Boots et al, AIDS Res. Hum. Retro. 13:1549 (1997), Moore et al, J. Virol. 68:8350 (1994), Sullivan et al, J. Virol. 72:4694 (1998), Fouts et al, J. Virol. 71:2779 (1997), Ye et al, J. Virol. 74:11955 (2000)). One A32 mab has been shown to mimic CD4 and when bound to gp120, upregulates (exposes) the CCR5 binding site (Wyatt et al, J. Virol. 69:5723 (1995)). Ligation of gp120 with such a ligand also upregulates the CD4 binding site and does not block CD4 binding to gp120. Advantageously, such ligands also upregulate the HR-2 binding site of gp41 bound to cleaved gp120, uncleaved gp140 and cleaved gp41, thereby further exposing HR-2 binding sites on these proteins—each of which are potential targets for anti-HIV neutralizing antibodies.

In a specific aspect of this embodiment, the immunogen comprises soluble HIV consensus or ancestral gp120 envelope ligated with either an intact A32 mab, a Fab2 fragment of an A32 mab, or a Fab fragment of an A32 mab, with the result that the CD4 binding site, the CCR5 binding site and the HR-2 binding site on the consensus or ancestral envelope are exposed/upregulated. The immunogen can comprise consensus or ancestral envelope with an A32 mab (or fragment thereof) bound or can comprise consensus or ancestral envelope with an A32 mab (or fragment thereof) bound and cross-linked with a cross-linker such as 0.3% formaldehyde or a heterobifunctional cross-linker such as DTSSP (Pierce Chemical Company). The immunogen can also comprise uncleaved consensus or ancestral gp140 or a mixture of uncleaved gp140, cleaved gp41 and cleaved gp120. An A32 mab (or fragment thereof) bound to consensus or ancestral gp140 and/or gp120 or to gp120 non-covalently bound to gp41, results in upregulation (exposure) of HR-2 binding sites in gp41, gp120 and uncleaved gp140. Binding of an A32 mab (or fragment thereof) to gp120 or gp140 also results in upregulation of the CD4 binding site and the CCR5 binding site. As with gp120 containing complexes, complexes comprising uncleaved gp140 and an A32 mab (or fragment thereof) can be used as an immunogen uncross-linked or cross-linked with cross-linker such as 0.3% formaldehyde or DTSSP. In one embodiment, the invention relates to an immunogen comprising soluble uncleaved consensus or ancestral gp140 bound and cross linked to a Fab fragment or whole A32 mab, optionally bound and cross-linked to an HR-2 binding protein.

The consensus or ancestral envelope protein triggered with a ligand that binds to the A32 mab binding site on gp120 can be administered in combination with at least a second immunogen comprising a second envelope, triggered by a ligand that binds to a site distinct from the A32 mab binding site, such as the CCR5 binding site recognized by mab 17b. The 17b mab (Kwong et al, Nature 393:648 (1998) available from the AIDS Reference Repository, NIAID, NIH) augments sCD4 binding to gp120. This second immunogen (which can also be used alone or in combination with triggered immunogens other than that described above) can, for example, comprise soluble HIV consensus or ancestral envelope ligated with either the whole 17b mab, a Fab2 fragment of the 17b mab, or a Fab fragment of the 17b mab. It will be appreciated that other CCR5 ligands, including other antibodies (or fragments thereof), that result in the CD4 binding site being exposed can be used in lieu of the 17b mab. This further immunogen can comprise gp120 with the 17b mab, or fragment thereof, (or other CCR5 ligand as indicated above) bound or can comprise gp120 with the 17b mab, or fragment thereof, (or other CCR5 ligand as indicated above) bound and cross-linked with an agent such as 0.3% formaldehyde or a heterobifunctional cross-linker, such as DTSSP (Pierce Chemical Company). Alternatively, this further immunogen can comprise uncleaved gp140 present alone or in a mixture of cleaved gp41 and cleaved gp120. Mab 17b, or fragment thereof (or other CCR5 ligand as indicated above) bound to gp140 and/or gp120 in such a mixture results in exposure of the CD4 binding region. The 17b mab, or fragment thereof, (or other CCR5 ligand as indicated above) gp140 complexes can be present uncross-linked or cross-linked with an agent such as 0.3% formaldehyde or DTSSP.

Soluble HR-2 peptides, such as T649Q26L and DP178, can be added to the above-described complexes to stabilize epitopes on consensus gp120 and gp41 as well as uncleaved consensus gp140 molecules, and can be administered either cross-linked or uncross-linked with the complex.

A series of monoclonal antibodies (mabs) have been made that neutralize many HIV primary isolates, including, in addition to the 17b mab described above, mab IgG1b12 that binds to the CD4 binding site on gp120 (Roben et al, J. Virol. 68:482 (1994), Mo et al, J. Virol. 71:6869 (1997)), mab 2G12 that binds to a conformational determinant on gp120 (Trkola et al, J. Virol. 70:1100 (1996)), and mab 2F5 that binds to a membrane proximal region of gp41 (Muster et al, J. Virol. 68:4031 (1994)).

As indicated above, various approaches can be used to "freeze" fusogenic epitopes in accordance with the invention. For example, "freezing" can be effected by addition of the DP-178 or T-649Q26L peptides that represent portions of the coiled coil region, and that when added to CD4-triggered consensus or ancestral envelope, result in prevention of fusion (Rimsky et al, J. Virol. 72:986-993 (1998)). HR-2 peptide bound consensus or ancestral gp120, gp140, gp41 or gp160 can be used as an immunogen or crosslinked by a reagent such as DTSSP or DSP (Pierce Co.), formaldehyde or other crosslinking agent that has a similar effect.

"Freezing" can also be effected by the addition of 0.1% to 3% formaldehyde or paraformaldehyde, both protein cross-linking agents, to the complex, to stabilize the CD4, CCR5 or CXCR4, HR-2 peptide gp160 complex, or to stabilize the "triggered" gp41 molecule, or both (LaCasse et al, Science 283:357-362 (1999)).

Further, "freezing" of consensus or ancestral gp41 or gp120 fusion intermediates can be effected by addition of heterobifunctional agents such as DSP (dithiobis[succimidylproprionate]) (Pierce Co. Rockford, Ill., No. 22585ZZ) or the water soluble DTSSP (Pierce Co.) that use two NHS esters that are reactive with amino groups to cross link and stabilize the CD4, CCR5 or CXCR4, HR-2 peptide gp160 complex, or to stabilize the "triggered" gp41 molecule, or both.

Analysis of T cell immune responses in immunized or vaccinated animals and humans shows that the envelope protein is normally not a main target for T cell immune response although it is the only gene that induces neutralizing antibodies. HIV-1 Gag, Pol and Nef proteins induce a potent T cell immune response. Accordingly, the invention includes a repertoire of consensus or ancestral immunogens that can induce both humoral and cellular immune responses. Subunits of consensus or ancestral sequences can be used as T or B cell immunogens. (See Examples 6 and 7, and Figures referenced therein, and FIGS. 63-127.

The immunogen of the invention can be formulated with a pharmaceutically acceptable carrier and/or adjuvant (such as alum) using techniques well known in the art. Suitable routes of administration of the present immunogen include systemic (e.g. intramuscular or subcutaneous). Alternative routes can be used when an immune response is sought in a mucosal immune system (e.g., intranasal).

The immunogens of the invention can be chemically synthesized and purified using methods which are well known to the ordinarily skilled artisan. The immunogens can also be synthesized by well-known recombinant DNA techniques. Nucleic acids encoding the immunogens of the invention can be used as components of, for example, a DNA vaccine wherein the encoding sequence is administered as naked DNA or, for example, a minigene encoding the immunogen can be present in a viral vector. The encoding sequence can be present, for example, in a replicating or non-replicating adenoviral vector, an adeno-associated virus vector, an attenuated *mycobacterium tuberculosis* vector, a *Bacillus* Calmette Guerin (BCG) vector, a vaccinia or Modified Vaccinia Ankara (MVA) vector, another pox virus vector, recombinant polio and other enteric virus vector, *Salmonella* species bacterial vector, *Shigella* species bacterial vector, Venezuelean Equine Encephalitis Virus (VEE) vector, a Semliki Forest Virus vector, or a Tobacco Mosaic Virus vector. The encoding sequence, can also be expressed as a DNA plasmid with, for example, an active promoter such as a CMV promoter. Other live vectors can also be used to express the sequences of the invention. Expression of the immunogen of the invention can be induced in a patient's own cells, by introduction into those cells of nucleic acids that encode the immunogen, preferably using codons and promoters that optimize expression in human cells. Examples of methods of making and using DNA vaccines are disclosed in U.S. Pat. Nos. 5,580,859, 5,589,466, and 5,703,055.

The composition of the invention comprises an immunologically effective amount of the immunogen of this invention, or nucleic acid sequence encoding same, in a pharmaceutically acceptable delivery system. The compositions can be used for prevention and/or treatment of immunodeficiency virus infection. The compositions of the invention can be formulated using adjuvants, emulsifiers, pharmaceutically-acceptable carriers or other ingredients routinely provided in vaccine compositions. Optimum formulations can be readily designed by one of ordinary skill in the art and can include formulations for immediate release and/or for sustained release, and for induction of systemic immunity and/or induction of localized mucosal immunity (e.g, the formulation can be designed for intranasal administration). The present compositions can be administered by any convenient route including subcutaneous, intranasal, oral, intramuscular, or other parenteral or enteral route. The immunogens can be administered as a single dose or multiple doses. Optimum immunization schedules can be readily determined by the ordinarily skilled artisan and can vary with the patient, the composition and the effect sought.

The invention contemplates the direct use of both the immunogen of the invention and/or nucleic acids encoding same and/or the immunogen expressed as minigenes in the vectors indicated above. For example, a minigene encoding the immunogen can be used as a prime and/or boost.

The invention includes any and all amino acid sequences disclosed herein and, where applicable, CF and CFI forms thereof, as well as nucleic acid sequences encoding same (and nucleic acids complementary to such encoding sequences).

Certain aspects of the invention can be described in greater detail in the non-limiting Examples that follows.

EXAMPLE 1

Artificial HIV-1 Group M Consensus Envelope

Experimental Details

Expression of CON6 gp120 and gp140 proteins in recombinant vaccinia viruses (VV). To express and purify the secreted form of HIV-1 CON6 envelope proteins, CON6 gp120 and gp140CF plasmids were constructed by introducing stop codons after the gp120 cleavage site (REKR) (SEQ ID NO:319) and before the transmembrane domain (YIKIFIMIVGGLIGLRIVFAVLSIVN) (SEQ ID NO:320), respectively. The gp120/gp41 cleavage site and fusion domain of gp41 were deleted in the gp140CF protein. Both CON6 gp120 and gp140CF DNA constructs were cloned into the pSC65 vector (from Bernard Moss, NIH, Bethesda, Md.) at SalI and KpnI restriction enzyme sites. This vector contains the lacZ gene that is controlled by the p7.5 promoter. A back-to-back P E/L promoter was used to express CON6 env genes. BSC-1 cells were seeded at $2\times10^5$ in each well in a 6-well plate, infected with wild-type vaccinia virus (WR) at a MOI of 0.1 pfu/cell, and 2 hr after infection, pSC65-derived plasmids containing CON6 env genes were transfected into the VV-infected cells and recombinant (r) VV selected as described (Moss and Earl, Current Protocols in Molecular Biology, eds, Ausubel et al (John Wiley & Sons, Inc. Indianapolis, Ind.) pp. 16.15.1-16.19.9 (1998)). Recombinant VV that contained the CON6 env genes were confirmed by PCR and sequencing analysis. Expression of the CON6 envelope proteins was confirmed by SDS-PAGE and Western blot assay. Recombinant CON6 gp120 and gp140CF were purified with agarose *galanthus Nivalis* lectin beads (Vector Labs, Burlingame, Calif.), and stored at −70° C. until use. Recombinant VV expressing JRFL (vCB-28) or 96ZM651

(vT241R) gp160 were obtained from the NIH AIDS Research and Reference Reagent Program (Bethesda, Md.).

Monoclonal Antibodies and gp120 Wild-type Envelopes. Human mabs against a conformational determinant on gp120 (A32), the gp120 V3 loop (F39F) and the CCR5 binding site (17b) were the gifts of James Robinson (Tulane Medical School, New Orleans, La.) (Wyatt et al, Nature 393; 705-711 (1998), Wyatt et al, J. Virol. 69:5723-5733 (1995)). Mabs 2F5, 447, b12, 2G12 and soluable CD4 were obtained from the NIH AIDS Research and Reference Reagent Program (Bethesda, Md.) (Gorny et al, J. Immunol. 159:5114-5122 (1997), Nyambi et al, J. Virol. 70:6235-6243 (1996), Purtscher et al, AIDS Res. Hum. Retroviruses 10:1651-1658 (1994), Trkola et al, J. Virol 70:1100-1108 (1996)). T8 is a murine mab that maps to the gp120 C1 region (a gift from P. Earl, NIH, Bethesda, Md.). BaL (subtype B), 96ZM651 (subtype C), and 93TH975 (subtype E) gp120s were provided by QBI, Inc. and the Division of AIDS, NIH. CHO cell lines that express 92U037 (subtype A) and 93BR029 (subtype F) gp140 (secreted and uncleaved) were obtained from NICBS, England.

Surface Plasmon Resonance Biosensor (SPR) Measurements and ELISA. SPR biosensor measurements were determined on a BIAcore 3000 instrument (BIAcore Inc., Uppsala, Sweden) instrument and data analysis was performed using BIAevaluation 3.0 software (BIAcore Inc, Upsaala, Sweden). Anti-gp120 mabs (T8, A32, 17b, 2G12) or sCD4 in 10 mM Na-acetate buffer, pH 4.5 were directly immobilized to a CM5 sensor chip using a standard amine coupling protocol for protein immobilization. FPLC purified CON6 gp120 monomer or gp140CF oligomer recombinant proteins were flowed over CM5 sensor chips at concentrations of 100 and 300 μg/ml, respectively. A blank in-line reference surface (activated and de-activated for amine coupling) or non-bonding mab controls were used to subtract non-specific or bulk responses. Soluble 89.6 gp120 and irrelevant IgG was used as a positive and negative control respectively and to ensure activity of each mab surface prior to injecting the CON6 Env proteins. Binding of CON6 envelope proteins was monitored in real-time at 25° C. with a continuous flow of PBS (150 mM NaCl, 0.005% surfactant P20), pH 7.4 at 10-30 μl/min. Bound proteins were removed and the sensor surfaces were regenerated following each cycle of binding by single or duplicate 5-10 μl pulses of regeneration solution (10 mM glycine-HCl, pH 2.9). ELISA was performed to determine the reactivity of various mabs to CON6 gp120 and gp140CF proteins as described (Haynes et al, AIDS Res. Hum. Retroviruses 11:211-221 (1995)). For assay of human mab binding to rgp120 or gp140 proteins, end-point titers were defined as the highest titer of mab (beginning at 20 μg/ml) at which the mab bound CON6 gp120 and gp140CF Env proteins≧3 fold over background control (non-binding human mab).

Infectivity and coreceptor usage assays. HIV-1/SG3Δenv and CON6 or control env plasmids were cotransfected into human 293T cells. Pseudotyped viruses were harvested, filtered and p24 concentration was quantitated (DuPont/NEN Life Sciences, Boston, Mass.). Equal amounts of p24 (5 ng) for each pseudovirion were used to infect JC53-BL cells to determine the infectivity (Derdeyn e al, J. Virol. 74:8358-8367 (2000), Wei et al, Antimicrob Agents Chemother. 46:1896-1905 (2002)). JC53-BL cells express CD4, CCR5 and CXCR4 receptors and contain a β-galactosidase (β-gal) gene stably integrated under the transcriptional control of an HIV-1 long terminal repeat (LTR). These cells can be used to quantify the infectious titers of pseudovirion stocks by staining for β-gal expression and counting the number of blue cells (infectious units) per microgram of p24 of pseudovirons (IU/μg p24) (Derdeyn e al, J. Virol. 74:8358-8367 (2000), Wei et al, Antimicrob Agents Chemother. 46:1896-1905 (2002)). To determine the coreceptor usage of the CON6 env gene, JC53BL cells were treated with 1.2 μM AMD3100 and 4 μM TAK-7.99 for 1 hr at 37° C. then infected with equal amounts of p24 (5 ng) of each Env pseudotyped virus. The blockage efficiency was expressed as the percentage of the infectious units from blockage experiments compared to that from control culture without blocking agents. The infectivity from control group (no blocking agent) was arbitrarily set as 100%.

Immunizations. All animals were housed in the Duke University Animal Facility under AALAC guidelines with animal use protocols approved by the Duke University Animal Use and Care Committee. Recombinant CON6 gp120 and gp140CF glycoproteins were formulated in a stable emulsion with RIBI-CWS adjuvant based on the protocol provided by the manufacturer (Sigma Chemical Co., St. Louis, Mo.). For induction of anti-envelope antibodies, each of four out-bred guinea pigs (Harlan Sprague, Inc., Chicago, Ill.) was given 100 μg either purified CON6 gp120 or gp140CF subcutaneously every 3 weeks (total of 5 immunizations). Serum samples were heat-inactivated (56° C., 1 hr), and stored at −20° C. until use.

For induction of anti-envelope T cell responses, 6-8 wk old female BALB/c mice (Frederick Cancer Research and Developmental Center, NCI, Frederick, Md.) were immunized i.m. in the quadriceps with 50 μg plasmid DNA three times at a 3-week interval. Three weeks after the last DNA immunization, mice were boosted with $10^7$ PFU of rVV expressing Env proteins. Two weeks after the boost, all mice were euthanized and spleens were removed for isolation of splenocytes.

Neutralization assays. Neutralization assays were performed using either a MT-2 assay as described in Bures et al, AIDS Res. Hum. Retroviruses 16:2019-2035 (2000), a luciferase-based multiple replication cycle HIV-1 infectivity assay in 5.25.GFP.Luc.M7 cells using a panel of HIV-1 primary isolates (Bures et al, AIDS Res. Hum. Retroviruses 16:2019-2035 (2000), Bures et al, J. Virol. 76:2233-2244 (2002)), or a syncytium (fusion from without) inhibition assay using inactivated HIV-1 virions (Rossio et al, J. Virol. 72:7992-8001 (1998)). In the luciferase-based assay, neutralizing antibodies were measured as a function of a reduction in luciferase activity in 5.25.EGFP.Luc.M7 cells provided by Nathaniel R. Landau, Salk Institute, La Jolla, Calif. (Brandt et al, J. Biol. Chem. 277:17291-17299 (2002)). Five hundred tissue culture infectious dose 50 ($TCID_{50}$) of cell-free virus was incubated with indicated serum dilutions in 150 μl (1 hr, at 37° C.) in triplicate in 96-well flat-bottom culture plates. The 5.25.EGFP.Luc.M7 cells were suspended at a density of $5\times10^5$/ml in media containing DEAE dextran (10 μg/ml). Cells (100 μl) were added and until 10% of cells in control wells (no test serum sample) were positive for GFP expression by fluorescence microscopy. At this time the cells were concentrated 2-fold by removing one-half volume of media. A 50 μl suspension of cells was transferred to 96-well white solid plates (Costar, Cambridge, Mass.) for measurement of luciferase activity using Bright-Glo™ substrate (Promega, Madison, Wis.) on a Wallac 1420 Multilabel Counter (PerkinElmer Life Sciences, Boston, Mass.). Neutralization titers in the MT-2 and luciferase assays were those where ≧50% virus infection was inhibited. Only values that titered beyond 1:20 (i.e. >1:30) were considered significantly positive. The syncytium inhibition "fusion from without" assay utilized HIV-1 aldrithiol-2 (AT-2) inactivated virions from HIV-1 subtype B strains ADA and AD8 (the gift of Larry Arthur and Jeffrey Lifson, Frederick Research Cancer Facility, Frederick, Md.)

added to SupT1 cells, with syncytium inhibition titers determined as those titers where ≧90% of syncytia were inhibited compared to prebleed sera.

Enzyme linked immune spot (ELISPOT) assay. Single-cell suspensions of splenocytes from individual immunized mice were prepared by mincing and forcing through a 70 μm Nylon cell strainer (BD Labware, Franklin Lakes, N.J.). Overlapping Env peptides of CON6 gp140 (159 peptides, 15mers overlapping by 11) were purchased from Boston Bioscience, Inc (Royal Oak, Mich.). Overlapping Env peptides of MN gp140 (subtype B; 170 peptides, 15mers overlapping by 11) and Chn19 gp140 (subtype C; 69 peptides, 20mers overlapping by 10) were obtained from the NIH AIDS Research and Reference Reagent Program (Bethesda, Md.). Splenocytes (5 mice/group) from each mouse were stimulated in vitro with overlapping Env peptides pools from CON6, subtype B and subtype C Env proteins. 96-well PVDF plates (MultiScreen-IP, Millipore, Billerica, Mass.) were coated with anti-IFN-γ mab (5 μg/ml, AN18; Mabtech, Stockholm, Sweden). After the plates were blocked at 37° C. for 2 hr using complete Hepes buffered RPMI medium, 50 μl of the pooled overlapping envelope peptides (13 CON6 and MN pools, 13-14 peptides in each pool; 9 Chn19 pool, 7-8 peptide in each pool) at a final concentration of 5 μg/ml of each were added to the plate. Then 59 μl of splenocytes at a concentration of 1.0× $10^7$/ml were added to the wells in duplicate and incubated for 16 hr at 37° C. with 5% $CO_2$. The plates were incubated with 100 μl of a 1:1000 dilution of streptavidin alkaline phosphatase (Mabtech, Stockholm, Sweden), and purple spots developed using 100 μl of BCIP/NBT (Plus) Alkaline Phosphatase Substrate (Moss, Pasadena, Md.). Spot forming cells (SFC) were measured using an Immunospot counting system (CTL Analyzers, Cleveland, Ohio). Total responses for each envelope peptide pool are expressed as SFCs per $10^6$ splenocytes.

Results

CON6 Envelope Gene Design, Construction and Expression. An artificial group M consensus env gene (CON6) was constructed by generating consensus sequences of env genes for each HIV-1 subtype from sequences in the Los Alamos HIV Sequence Database, and then generating a consensus sequence of all subtype consensuses to avoid heavily sequenced subtypes (Gaschen et al, Science 296:2354-2360 (2002), Korber et al, Science 288:1789-1796 (2000)). Five highly variable regions from a CRF08_BC recombinant strain (98CN006) (V1, V2, V4, V5 and a region in cytoplasmic domain of gp41) were then used to fill in the missing regions in CON6 sequence. The CON6 V3 region is group M consensus (FIG. 1A). For high levels of expression, the codons of CON6 env gene were optimized based on codon usage for highly expressed human genes (Haas et al, Curr. Biol. 6:315-324 (2000), Andre et al, J. Virol. 72:1497-1503 (1998)). (See FIG. 1D.) The codon optimized CON6 env gene was constructed and subcloned into pcDNA3.1 DNA at EcoR I and BamH I sites (Gao et al, AIDS Res. Hum. Retroviruses, 19:817-823 (2003)). High levels of protein expression were confirmed with Western-blot assays after transfection into 293T cells. To obtain recombinant CON6 Env proteins for characterization and use as immunogens, rVV was generated to express secreted gp120 and uncleaved gp140CF (FIG. 1B). Purity for each protein was ≧90% as determined by Coomassie blue gels under reducing conditions (FIG. 1C).

Figure 2E:
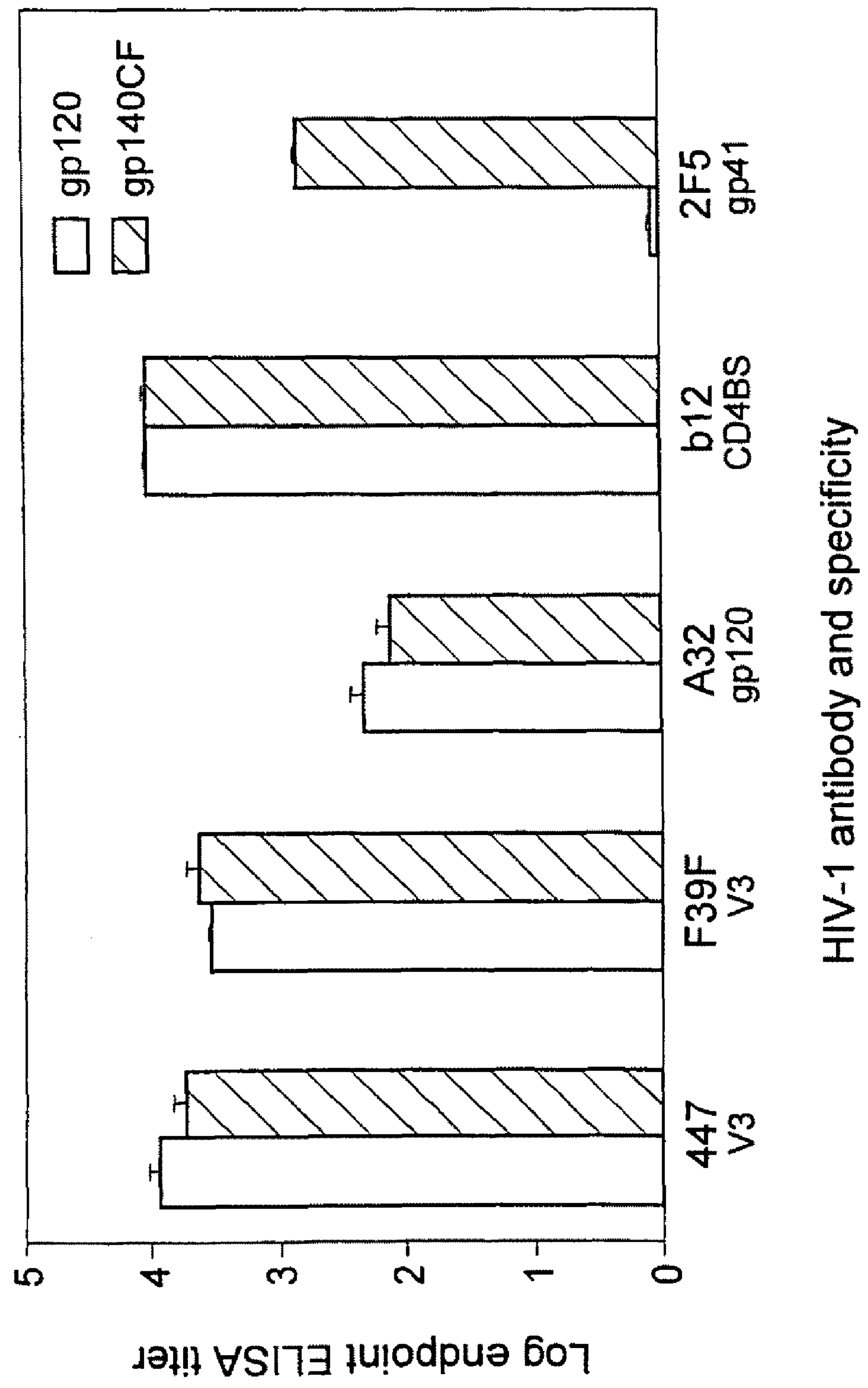

CD4 Binding Domain and Other Wild-type HIV-1 Epitopes are Preserved on CON6 Proteins. To determine if CON6 proteins can bind to CD4 and express other wild-type HIV-1 epitopes, the ability of CON6 gp120 and gp140CF to bind soluble(s) CD4, to bind several well-characterized anti-gp120 mabs, and to undergo CD4-induced conformational changes was assayed. First, BIAcore CM5 sensor chips were coated with either sCD4 or mabs to monitor their binding activity to CON6 Env proteins. It was found that both monomeric CON6 gp120 and oligomeric gp140CF efficiently bound sCD4 and anti-gp120 mabs T8, 2G12 and A32, but did not constitutively bind mab 17b, that recognizes a CD4 inducible epitope in the CCR5 binding site of gp120 (FIGS. 2A and 2B). Both sCD4 and A32 can expose the 17b binding epitope after binding to wild-type gp120 (Wyatt et al, Nature 393; 705-711 (1998), Wyatt et al, J. Virol. 69:5723-5733 (1995)). To determine if the 17b epitope could be induced on CON6 Envs by either sCD4 or A32, sCD4, A32 and T8 were coated on sensor chips, then CON6 gp120 or gp140CF captured, and mab 17b binding activity monitored. After binding sCD4 or mab A32, both CON6 gp120 and gp140CF were triggered to undergo conformational changes and bound mab 17b (FIGS. 2C and 2D). In contrast, after binding mab T8, the 17b epitope was not exposed (FIGS. 2C and 2D). ELISA was next used to determine the reactivity of a panel of human mabs against the gp120 V3 loop (447, F39F), the CD4 binding site (b12), and the gp41 neutralizing determinant (2F5) to CON6 gp120 and gp140CF (FIG. 2E). Both CON6 rgp120 and rgp140CF proteins bound well to neutralizing V3 mabs 447 and F39F and to the potent neutralizing. CD4 binding site mab b12. Mab 2F5, that neutralizes HIV-1 primary isolates by binding to a C-terminal gp41 epitope, also bound well to CON6 gp140CF (FIG. 2E).

Figure 3A:
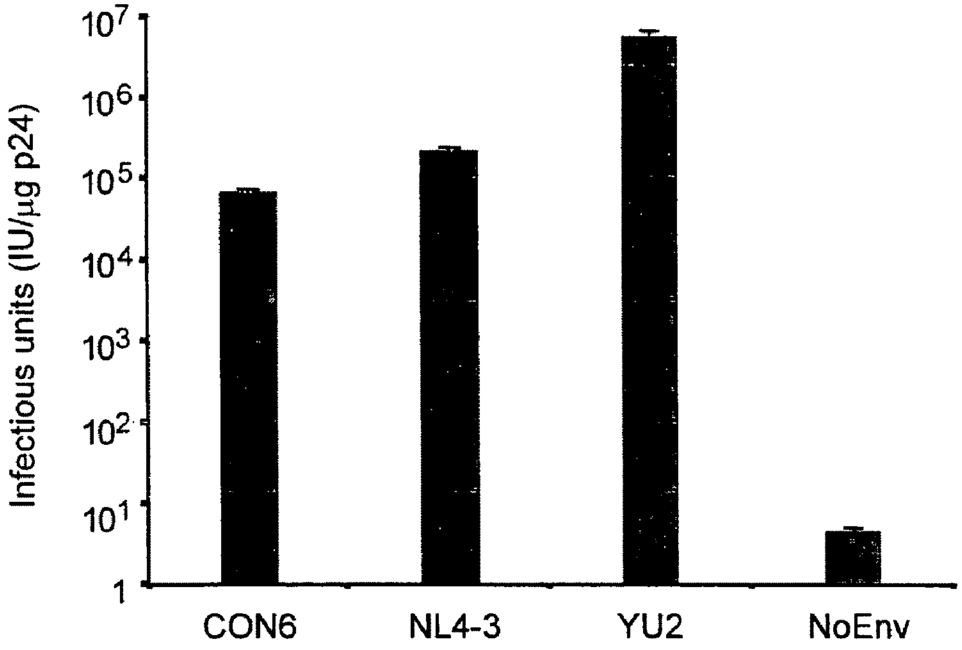
FIGS. 3A and 3B. Infectivity and coreceptor usage of CON6 envelope.

CON6 env Gene is Biologically Functional and Uses CCR5 as its Coreceptor. To determine whether CON6 envelope gene is biologically functional, it was co-transfected with the env-defective SG3 proviral clone into 293T cells. The pseudotyped viruses were harvested and JC53BL cells infected. Blue cells were detected in JC53-BL cells infected with the CON6 Env pseudovirions, suggesting that CON6 Env protein is biologically functional (FIG. 3A). However, the infectious titers were 1-2 logs lower than that of pseudovirions with either YU2 or NL4-3 wild-type HIV-1 envelopes.

Figure 3B:
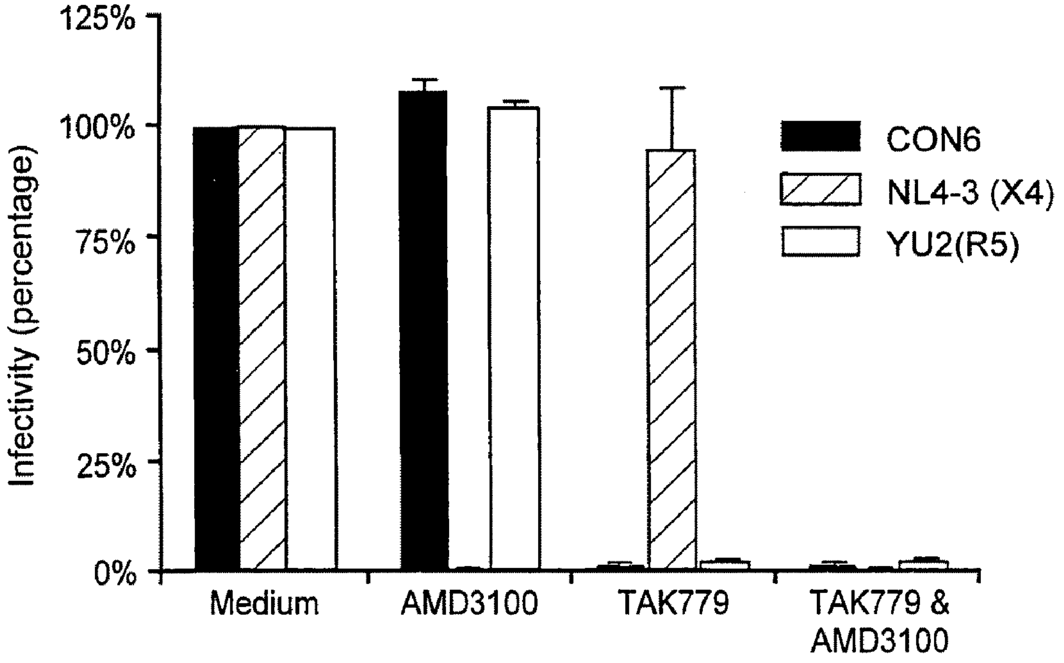

The co-receptor usage for the CON6 env gene was next determined. When treated with CXCR4 blocking agent AMD3100, the infectivity of NL4-3 Env-pseudovirons was blocked while the infectivity of YU2 or CON6 Env-pseudovirons was not inhibited (FIG. 3B). In contrast, when treated with CCR5 blocking agent TAK-779, the infectivity of NL4-3 Env-pseudovirons was not affected, while the infectivity of YU2 or CON6 Env-pseudovirons was inhibited. When treated with both blocking agents, the infectivity of all pseudovirions was inhibited. Taken together, these data show that the CON6 envelope uses the CCR5 co-receptor for its entry into target cells.

Figure 4:
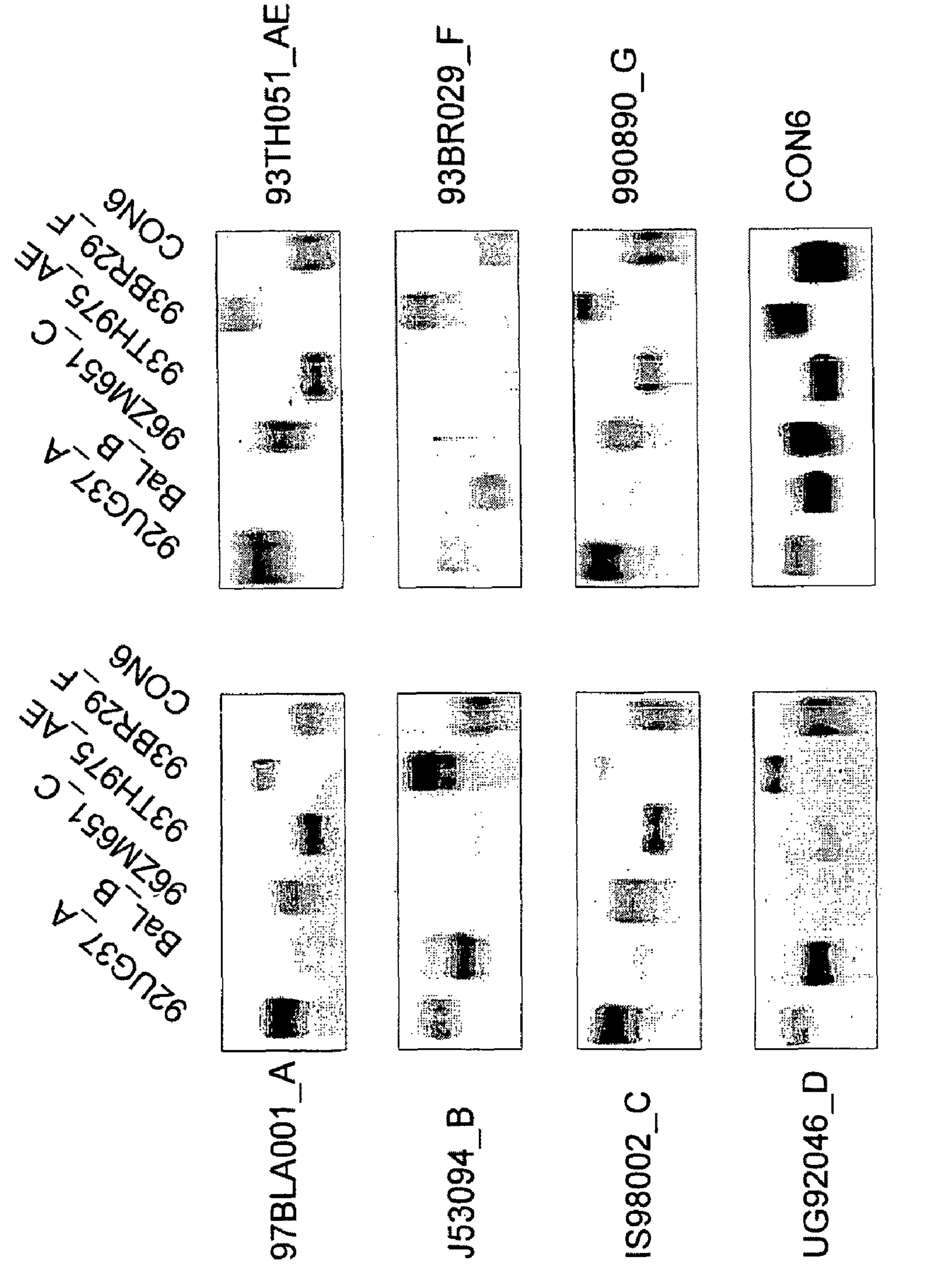
FIG. 4. Western blot analysis of multiple subtype Env proteins against multiple subtype antisera. Equal amount of Env proteins (100 ng) were separated on 10% SDS-polyacrylamide gels. Following electrophoresis, proteins were transferred to Hybond ECL nitrocellulose membranes and reacted with sera from HIV-1 infected patients (1:1,000) or guinea pigs immunized with CON6 gp120 DNA prime, rVV boost (1:1,000). Protein-bound antibody was probed with fluorescent-labeled secondary antibodies and the images scanned and recorded on an infrared imager Odyssey (Li-Cor, Lincoln, Nebr.). Subtypes are indicated by single-letters after Env protein and serum IDs. Four to six sera were tested for each subtype, and reaction patterns were similar among all sera from the same subtype. One representative result for each subtype serum is shown.

Reaction of CON6 gp120 With Different Subtype Sera. To determine if multiple subtype linear epitopes are preserved on CON6 gp120, a recombinant Env protein panel (gp120 and gp140) was generated. Equal amounts of each Env protein (100 ng) were loaded on SDS-polyacrylamide gels, transferred to nitrocellulose, and reacted with subtype A through G patient sera as well as anti-CON6 gp120 guinea pig sera (1:1,000 dilution) in Western blot assays. For each HIV-1 subtype, four to six patient sera were tested. One serum representative for each subtype is shown in FIG. 4.

It was found that whereas all subtype sera tested showed variable reactivities among Envs in the panel, all group M subtype patient sera reacted equally well with CON6 gp120 Env protein, demonstrating that wild-type HIV-1 Env epitopes recognized by patient sera were well preserved on the CON6 Env protein. A test was next made as to whether CON6 gp120 antiserum raised in guinea pigs could react to different subtype Env proteins. It was found that the CON6 serum reacted to its own and other subtype Env proteins equally well, with the exception of subtype A Env protein (FIG. 4).

Figure 5:
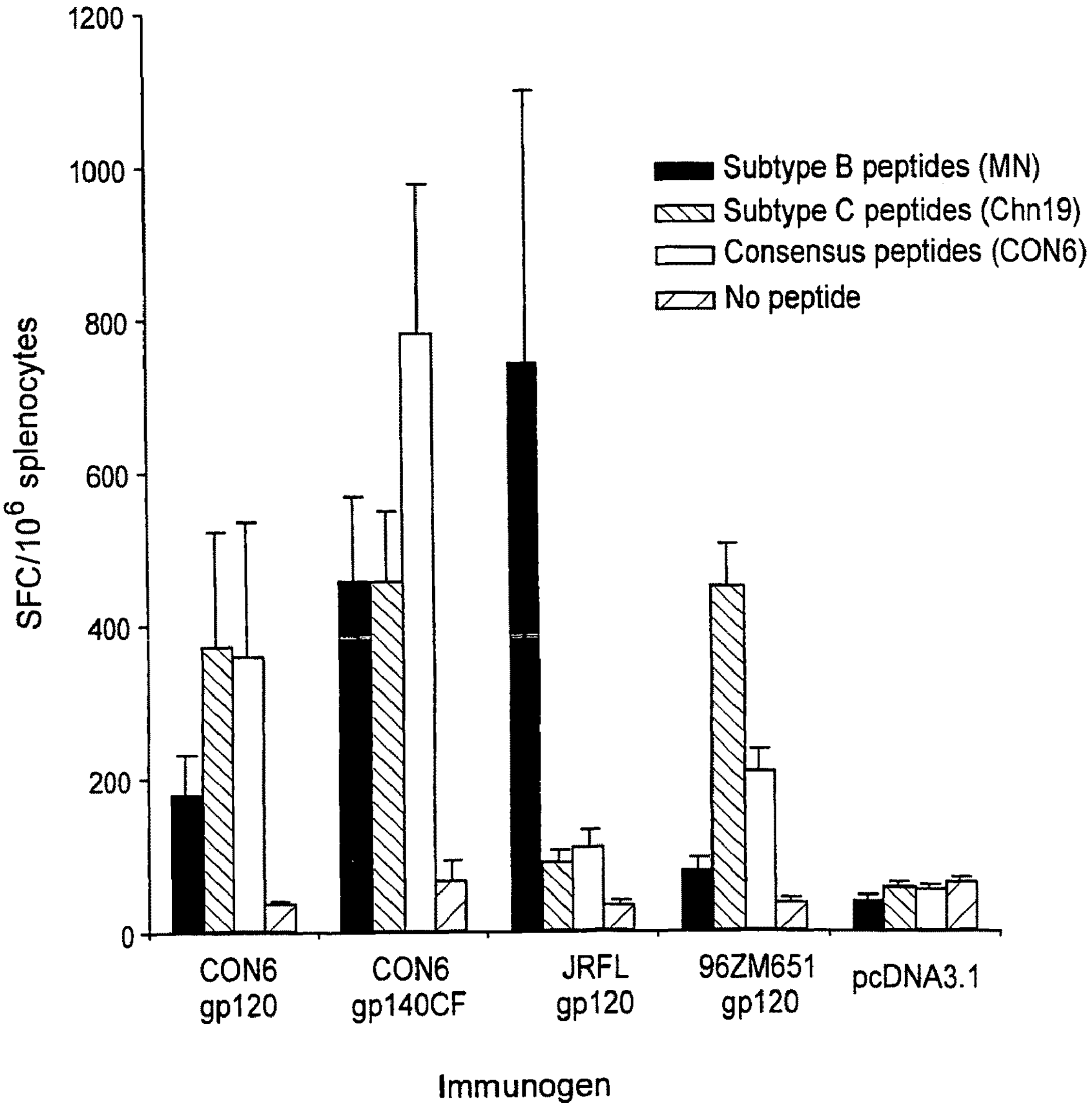
FIG. 5. T cell immune responses induced by CON6 Env immunogens in mice. Splenocytes were isolated from individual immunized mice (5 mice/group). After splenocytes were stimulated in vitro with overlapping Env peptide pools of CON6 (black column), subtype B (hatched column), subtype C (white column), and medium (no peptide; gray column), INF-γ producing cells were determined by the ELISPOT assay. T cell IFN-γ responses induced by either CON6 gp120 or gp140CF were compared to those induced by subtype specific Env immunogens (JRFL and 96ZM651). Total responses for each envelope peptide pool are expressed as SFCs per million splenocytes. The values for each column are the mean±SEM (of IFN-γ SFCs (n=5 mice/group).

Induction of T Cell Responses to CON6, Subtype B and Subtype C Envelope Overlapping Peptides. To compare T cell immune responses induced by CON6 Env immunogens with those induced by subtype specific immunogens, two additional groups of mice were immunized with subtype B or subtype C DNAs and with corresponding rVV expressing subtype B or C envelope proteins. Mice immunized with subtype B (JRFL) or subtype C (96ZM651) Env immunogen had primarily subtype-specific T cell immune responses (FIG. 5). IFN-γ SFCs from mice immunized with JRFL (subtype B) immunogen were detected after stimulation with subtype B (MN) peptide pools, but not with either subtype C (Chn19) or CON6 peptide pools. IFN-γ SFCs from mice immunized with 96ZM651 (subtype C) immunogen were detected after the stimulation with both subtype C (Chn19) and CON6 peptide pools, but not with subtype B (MN) peptide pools. In contrast, IFN-γ SFCs were identified from mice immunized with CON6 Env immunogens when stimulated with either CON6 peptide pools as well as by subtype B or C peptide pools (FIG. 5). The T cell immune responses induced by CON6 gp140 appeared more robust than those induced by CON6 gp120. Taken together, these data demonstrated that CON6 gp120 and gp140CF immunogens were capable of inducing T cell responses that recognized T cell epitopes of wild-type subtype B and C envelopes.

Induction of Antibodies by Recombinant CON6 gp120 and gp140CF Envelopes that Neutralize HIV-1 Subtype B and C Primary Isolates. To determine if the CON6 envelope immunogens can induce antibodies that neutralize HIV-1 primary isolates, guinea pigs were immunized with either CON6 gp120 or gp140CF protein. Sera collected after 4 or 5 immunizations were used for neutralization assays and compared to the corresponding prebleed sera. Two AT-2 inactivated HIV-1 isolates (ADA and AD8) were tested in syncytium inhibition assays (Table 5A). Two subtype B SHIV isolates, eight subtype B primary isolates, four subtype C, and one each subtype A, D, and E primary isolates were tested in either the MT-2 or the luciferase-based assay (Table 5B). In the syncytium inhibition assay, it was found that antibodies induced by both CON 6 gp120 and gp140CF proteins strongly inhibited AT-2 inactivated ADA and AD8-induced syncytia (Table 5A). In the MT-2 assay, weak neutralization of 1 of 2 SHIV isolates (SHIV SF162P3) by two gp120 and one gp140CF sera was found (Table 5B). In the luciferase-based assay, strong neutralization of 4 of 8 subtype B primary isolates (BXO8, SF162, SS1196, and BAL) by all gp120 and gp140CF sera was found, and weak neutralization of 2 of 8 subtype β isolates (6101, 0692) by most gp120 and gp140CF sera was found. No neutralization was detected against HIV-1 PAVO (Table 5B). Next, the CON6 anti-gp120 and gp140CF sera were tested against four subtype C HIV-1 isolates, and weak neutralization of 3 of 4 isolates (DU179, DU368, and S080) was found, primarily by anti-CON6 gp120 sera. One gp140CF serum, no. 653, strongly neutralized DU179 and weakly neutralized S080 (Table 5B). Finally, anti-CON6 Env sera strongly neutralized a subtype D isolate (93ZR001), weakly neutralized a subtype E (CM244) isolate, and did not neutralize a subtype A (92RW020) isolate.

TABLE 5A

Ability of HIV-1 Group M Consensus Envelope CON6 Proteins to Induce Fusion Inhibiting Antibodies

| Guinea Pig No. | Immunogen | Syncytium Inhibition antibody titer[1] AD8 | ADA |
|---|---|---|---|
| 646 | gp120 | 270 | 270 |
| 647 | gp120 | 90 | 90 |
| 648 | gp120 | 90 | 270 |
| 649 | gp120 | 90 | 90 |
| Geometric Mean Titer | | 119 | 156 |
| 650 | gp140 | 270 | 270 |
| 651 | gp140 | 90 | 90 |
| 652 | gp140 | ≧810 | 810 |
| 653 | gp140 | 270 | 90 |
| Geometric Mean Titer | | 270 | 207 |

[1]Reciprocal serum dilution at which HIV-induced syncytia of Sup T1 cells was inhibited by >90% compared to pre-immune serum. All prebleed sera were negative (titer < 10).

TABLE 5B

Ability of Group M Consensus HIV-1 Envelope CON6 gp120 and gp140CF Proteins to Induce Antibodies that Neutralize HIV Primary Isolates

| HIV Isolate | CON6 gp120 Protein Guinea Pig No. | | | | | CON6 gp140CF Protein Guinea Pig No. | | | | | Controls | | |
|---|---|---|---|---|---|---|---|---|---|---|---|---|---|
| (Subtype) | 646 | 647 | 648 | 649 | GMT | 650 | 651 | 652 | 653 | GMT | TriMab$_2$≠ | CD4-IgG2 | HIV + Serum |
| SHIV 89.6P*(B) | <20 | <20 | <20 | <20 | <20 | <20 | <20 | <20 | <20 | <20 | NT | NT | NT |
| SHIV SF162P3*(B) | <20 | 30 | 48 | <20 | <20 | 27 | <20 | <20 | <20 | <20 | NT | 0.2 μg/ml | NT |
| BX08(B) | 270 | 183 | 254 | 55 | 102 | 199 | 64 | 229 | 150 | 187 | 0.7 μg/ml | NT | 2384 |
| 6101(B) | <20 | 38 | 35 | <20 | <20 | <20 | 90 | 72 | 73 | 39 | 1.1 μg/ml | NT | NT |
| BG1168(B) | <20 | <20 | <20 | <20 | <20 | 40 | <20 | <20 | 25 | <20 | 2.7 μg/ml | NT | NT |
| 0692(B) | 31 | 32 | 34 | <20 | 24 | 28 | 33 | 30 | 45 | 33 | 0.8 μg/ml | NT | 769 |
| PAVO(B) | <20 | <20 | <20 | <20 | <20 | <20 | <20 | <20 | <20 | <20 | 2.9 μg/ml | NT | NT |
| SF162(B) | 2,146 | 308 | 110 | 282 | 379 | 206 | 5,502 | 15,098 | 174 | 1,313 | NT | NT | >540 |
| SS1196(B) | 206 | 26 | 148 | 59 | 83 | 381 | 401 | 333 | 81 | 253 | NT | NT | 301# |
| BAL(B) | 123 | 90 | 107 | 138 | 113 | 107 | 146 | 136 | 85 | 116 | NT | NT | 3307 |
| 92RW020(A) | <20 | <20 | <20 | <20 | <20 | <20 | <20 | <20 | <20 | <20 | NT | NT | 693 |
| DU179(C) | <20 | 43 | <20 | 24 | <20 | <20 | <20 | 24 | 515 | 33 | NT | 0.8 μg/ml | NT |
| DU368(C) | 25 | 35 | 62 | <20 | 27 | <20 | <20 | <20 | 23 | <20 | NT | 2.3 μg/ml | NT |
| S021(C) | <20 | <20 | 33 | <20 | <20 | <20 | <20 | <20 | <20 | <20 | NT | 8.3 μg/ml | NT |
| S080(C) | 24 | 37 | 70 | 41 | 40 | <20 | <20 | <20 | 52 | <20 | NT | 3.4 μg/ml | NT |

TABLE 5B-continued

Ability of Group M Consensus HIV-1 Envelope CON6 gp120 and gp140CF Proteins to Induce Antibodies that Neutralize HIV Primary Isolates

| HIV Isolate | CON6 gp120 Protein Guinea Pig No. | | | | | CON6 gp140CF Protein Guinea Pig No. | | | | | Controls | | |
|---|---|---|---|---|---|---|---|---|---|---|---|---|---|
| (Subtype) | 646 | 647 | 648 | 649 | GMT | 650 | 651 | 652 | 653 | GMT | TriMab$_2$≠ | CD4-IgG2 | HIV + Serum |
| 93ZR001(D) | 275 | 144 | 126 | 114 | 154 | 306 | 195 | 129 | 173 | 191 | NT | NT | 693 |
| CM244(E) | 35 | 43 | 64 | ND | 46 | 31 | 25 | 27 | 25 | 26 | NT | NT | 693 |

*MT-2 Assay; All other HIV isolates were tested in the M7-luciferase assay.

HIV-1 isolates QH0692, SS1196, SF162, 6101, BX08, BG1168, BAL were assayed with post-injection 5 serum; other HIV-1 isolates were assayed with post-injection 4 serum.

ND = not done.

HIV + sera was either HIV-1 + human serum (LEH3) or an anti-gp120 guinea pig serum (#) with known neutralizing activity for HIV-1 isolate SS1196. GMT = geometric mean titer of four animals per group. Neutralizing titers reported are after subtraction of any background neutralization in prebleed sera.

≠TriMab$_2$ = a mixture of human mabs 2F5, b12, 2G12.

Conclusions

The production of an artificial HIV-1 Group M consensus env genes (encoding sequences) (CON6 and Con-S) have been described that encodes a functional Env protein that is capable of utilizing the CCR5 co-receptor for mediating viral entry. Importantly, these Group M consensus envelope genes could induce T and B cell responses that recognized epitopes of subtype B and C HIV-1 primary isolates. In addition, Con-S induces antibodies that strongly neutralize Subtype-C and A HIV-1 strains (see Table 3).

The correlates of protection to HIV-1 are not conclusively known. Considerable data from animal models and studies in HIV-1-infected patients suggest the goal of HIV-1 vaccine development should be the induction of broadly-reactive CD4+ and CD8+ anti-HIV-1 T cell responses (Letvin et al, Annu. Rev. Immunol. 20:73-99 (2002)) and high levels of antibodies that neutralize HIV-1 primary isolates of multiple subtypes (Mascola et al, J. Virol. 73:4009-4018 (1999), Mascola et al, Nat. Med. 6:270-210 (2000)).

The high level of genetic variability of HIV-1 has made it difficult to design immunogens capable of inducing immune responses of sufficient breadth to be clinically useful. Epitope based vaccines for T and B cell responses (McMichael et al, Vaccine 20:1918-1921 (2002), Sbai et al, Curr. Drug Targets Infect, Disord. 1:303-313 (2001), Haynes, Lancet 348:933-937 (1996)), constrained envelopes reflective of fusion intermediates (Fouts et al, Proc. Natl. Acad. Sci. USA 99:11842-22847 (2002)), as well as exposure of conserved high-order structures for induction of anti-HIV-1 neutralizing antibodies have been proposed to overcome HIV-1 variability (Roben et al, J. Virol. 68:4821-4828 (1994), Saphire et al, Science 293: 1155-1159 (2001)). However, with the ever-increasing diversity and rapid evolution of HIV-1, the virus is a rapidly moving complex target, and the extent of complexity of HIV-1 variation makes all of these approaches problematic. The current most common approach to HIV-1 immunogen design is to choose a wild-type field HIV-1 isolate that may or may not be from the region in which the vaccine is to be tested. Polyvalent envelope immunogens have been designed incorporating multiple envelope immunogens (Bartlett et al, AIDS 12:1291-1300 (1998), Cho et al, J. Virol. 75:2224-2234 (2001)).

The above-described study tests a new strategy for HIV-1 immunogen design by generating a group M consensus env gene (CON6) with decreased genetic distance between this candidate immunogen and wild-type field virus strains. The CON6 env gene was generated for all subtypes by choosing the most common amino acids at most positions (Gaschen et al, Science 296:2354-2360 (2002), Korber et al, Science 288: 1789-1796 (2000)). Since only the most common amino acids were used, the majority of antibody and T cell epitopes were well preserved. Importantly, the genetic distances between the group M consensus env sequence and any subtype env sequences was about 15%, which is only half of that between wild-type subtypes (30%) (Gaschen et al, Science 296:2354-2360 (2002)). This distance is approximately the same as that among viruses within the same subtype. Further, the group M consensus env gene was also about 15% divergent from any recombinant viral env gene, as well, since CRFs do not increase the overall genetic divergence among subtypes.

Infectivity of CON6-Env pseudovirions was confirmed using a single-round infection system, although the infectivity was compromised, indicating the artificial envelope was not in an "optimal" functional conformation, but yet was able to mediate virus entry. That the CON6 envelope used CCR5 (R5) as its coreceptor is important, since majority of HIV-1 infected patients are initially infected with R5 viruses.

BIAcore analysis showed that both CON6 gp120 and gp140CF bound sCD4 and a number of mabs that bind to wild-type HIV-1 Env proteins. The expression of the CON6 gp120 and 140CF proteins that are similar antigenically to wild-type HIV-1 envelopes is an important step in HIV-1 immunogen development. However, many wild-type envelope proteins express the epitopes to which potent neutralizing human mabs bind, yet when used as immunogens themselves, do not induce broadly neutralizing anti-HIV-1 antibodies of the specificity of the neutralizing human mabs.

The neutralizing antibody studies were encouraging in that both CON6 gp120, CON6 gp140CF and Con-S gp140CFI induced antibodies that neutralized select subtype B, C and D HIV-1 primary isolates, with Con-S gp140CFI inducing the most robust neutralization of non-subtype B primary HIV isolates. However, it is clear that the most difficult-to-neutralize primary isolates (PAVO, 6101, BG1168, 92RW020, CM244) were either only weakly or not neutralized by anti-CON6 gp120 or gp140 sera (Table 4b). Nonetheless, the Con-S envelope immunogenicity for induction of neutralizing antibodies is promising, given the breadth of responses generated with the Con-S subunit gp140CFI envelope protein for non-subtype B HIV isolates. Previous studies with poxvirus constructs expressing gp120 and gp160 have not generated high levels of neutralizing antibodies (Evans et al, J. Infect. Dis. 180:290-298 (1999), Polacino et al, J. Virol. 73:618-630 (1999), Ourmanov et al, J. Virol. 74:2960-2965 (2000), Pal et al, J. Virol 76:292-302 (2002), Excler and Plotkin, AIDS 11 (Suppl A):S127-137 (1997). rVV expressing secreted CON6 gp120 and gp140 have been constructed and antibodies that neutralize HIV-1 primary isolates induced. An HIV neutralizing antibody immunogen can be a combination of Con-S gp140CFI, or subunit thereof, with immunogens that neutralize most subtype B isolates.

The structure of an oligomeric gp140 protein is critical when evaluating protein immunogenicity. In this regard, study of purified CON6 gp140CF proteins by fast performance liquid chromatography (FPLC) and analytical ultracentrifiguration has demonstrated that the purified gp140 peak consists predominantly of trimers with a small component of dimers.

Thus, centralized envelopes such as CON6, Con-S or 2003 group M or subtype consensus or ancestral encoding sequences described herein, are attractive candidates for preparation of various potentially "enhanced" envelope immunogens including CD4-Env complexes, constrained envelope structures, and trimeric oligomeric forms. The ability of CON6-induced T and B cell responses to protect against HIV-1 infection and/or disease in SHIV challenge models will be studied in non-human primates.

The above study has demonstrated that artificial centralized HIV-1 genes such as group M consensus env gene (CON6) and Con-S can also induce T cell responses to T cell epitopes in wild-type subtype B and C Env proteins as well as to those on group M consensus Env proteins (FIG. 5). While the DNA prime and rVV boost regimen with CON6 gp140CF immunogen clearly induced IFN-γ producing T cells that recognized subtype B and C epitopes, further studies are needed to determine if centralized sequences such as are found in the CON6 envelope are significantly better at inducing cross-clade T cell responses than wild-type HIV-1 genes (Ferrari et al, Proc. Natl. Acad. Sci. USA 94:1396-1401 (1997), Ferrari et al, AIDS Res. Hum. Retroviruses 16:1433-1443 (2000)). However, the fact that CON6 (and Con-S; env encoding sequence) prime and boosted splenocyte T cells recognized HIV-1 subtype B and C T cell epitopes is an important step in demonstration that CON6 (and Con-S) can induce T cell responses that might be clinically useful.

Three computer models (consensus, ancestor and center of the tree (COT)) have been proposed to generate centralized HIV-1 genes (Gaschen et al, Science 296:2354-2360 (2002), Gao et al, Science 299:1517-1518 (2003), Nickle et al, Science 299:1515-1517 (2003), Korber et al, Science 288:1789-1796 (2000). They all tend to locate at the roots of the star-like phylogenetic trees for most HIV-1 sequences within or between subtypes. As experimental vaccines, they all can reduce the genetic distances between immunogens and field virus strains. However, consensus, ancestral and COT sequences each have advantages and disadvantages (Gaschen et al, Science 296:2354-2360 (2002), Gao et al, Science 299: 1517-1518 (2003), Nickle et al, Science 299:1515-1517 (2003). Consensus and COT represent the sequences or epitopes in sampled current wild-type viruses and are less affected by outliers HIV-1 sequences, while ancestor represents ancestral sequences that can be significantly affected by outlier sequences. However, at present, it is not known which centralized sequence can serve as the best immunogen to elicit broad immune responses against diverse HIV-1 strains, and studies are in progress to test these different strategies.

Taken together, the data have shown that the HIV-1 artificial CON6 and Con-S envelope can induce T cell responses to wild-type HIV-1 epitopes, and can induce antibodies that neutralize HIV-1 primary isolates, thus demonstrating the feasibility and promise of using artificial centralized HIV-1 sequences in HIV-1 vaccine design.

EXAMPLE 2

HIV-1 Subtype C Ancestral and Consensus Envelope Glycoproteins

Experimental Details

HIV-1 subtype C ancestral and consensus env genes were obtained from the Los Alamos HIV Molecular Immunology Database (http://hiv-web.lanl.gov/immunology), codon-usage optimized for mammalian cell expression, and synthesized (FIG. 6). To ensure optimal expression, a Kozak sequence (GCCGCCGCC) was inserted immediately upstream of the initiation codon. In addition to the full-length genes, two truncated env genes were generated by introducing stop codons immediately after the gp41 membrane-spanning domain (IVNR) and the gp120/gp41 cleavage site (REKR), generating gp140 and gp120 form of the glycoproteins, respectively (FIG. 8).

Figure 7:
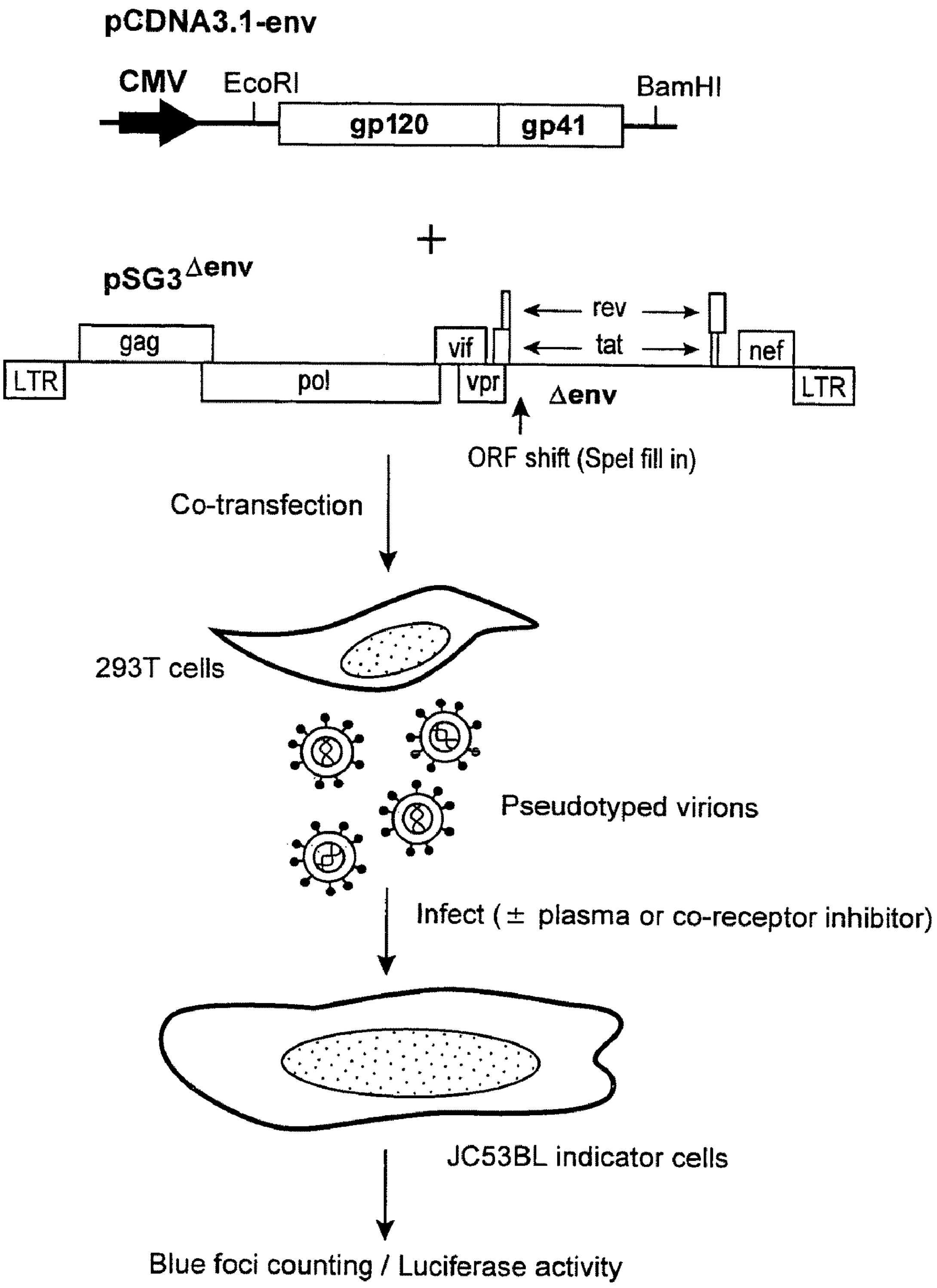
FIG. 7. JC53-BL cells are a derivative of HeLa cells that express high levels of CD4 and the HIV-1 coreceptors CCR5 and CXCR4. They also contain the reporter cassettes of luciferase and β-galactosidase that are each expressed from an HIV-1 LTR. Expression of the reporter genes is dependent on production of HIV-1 Tat. Briefly, cells are seeded into 24 or 96-well plates, incubated at 37° C. for 24 hours and treated with DEAE-Dextran at 37° C. for 30 minutes. Virus is serially diluted in 1% DMEM, added to the cells incubating in DEAE-Dextran, and allowed to incubate for 3 hours at 37° C. after which an additional cell media is added to each well. Following a final 48-hour incubation at 37° C., cells are either fixed, stained using X-Gal to visualize β-galactosidase expressing blue foci or frozen-thawed three times to measure luciferase activity.

Genes were tested for integrity in an in vitro transcription/translation system and expressed in mammalian cells. To determine if the ancestral and consensus subtype C envelopes were capable of mediating fusion and entry, gp160 and gp140 genes were co-transfected with an HIV-1/SG3Δenv provirus and the resulting pseudovirions tested for infectivity using the JC53-BL cell assay (FIG. 7). Co-receptor usage and envelope neutralization sensitivity were also determined with slight modifications of the JC53-BL assay. Codon-usage optimized and rev-dependent 96ZAM651 env genes were used as contemporary subtype C controls.

Results

Figure 9:
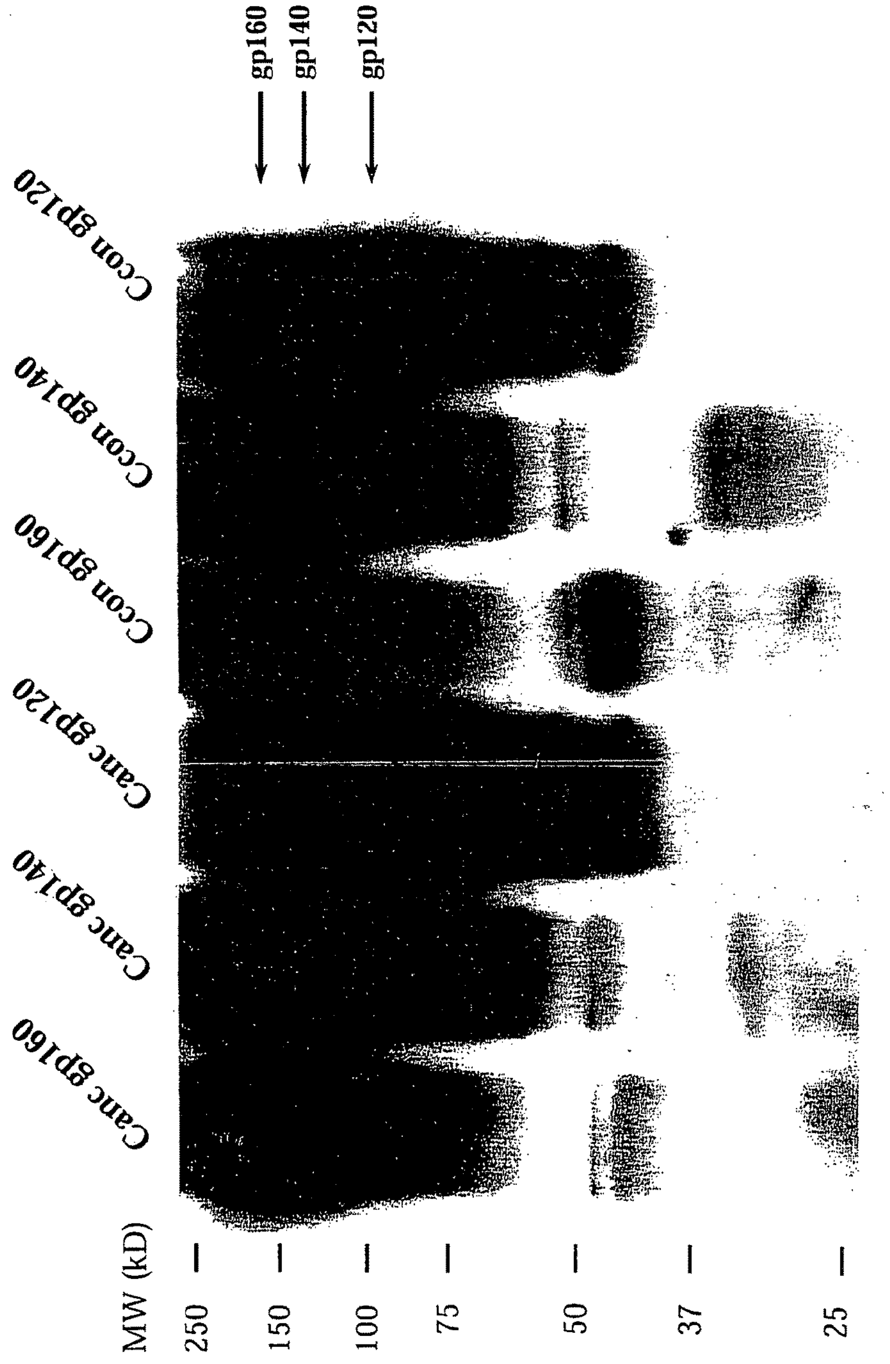
FIG. 9. Expression of subtype C ancestral and consensus envelopes in 293T cells. Plasmids containing codon-optimized gp160, gp140, or gp120 subtype C ancestral and consensus genes were transfected into 293T cells, and protein expression was examined by Western Blot analysis of cell lysates. 48-hours post-transfection, cell lysates were collected, total protein content determined by the BCA protein assay, and 2 μg of total protein was loaded per lane on a 4-20% SDS-PAGE gel. Proteins were transferred to a PVDF membrane and probed with HIV-1 plasma from a subtype C infected patient.

Codon-optimized subtype C ancestral and consensus envelope genes (gp160, gp140, gp120) express high levels of env glycoprotein in mammalian cells (FIG. 9).

Figure 10A:
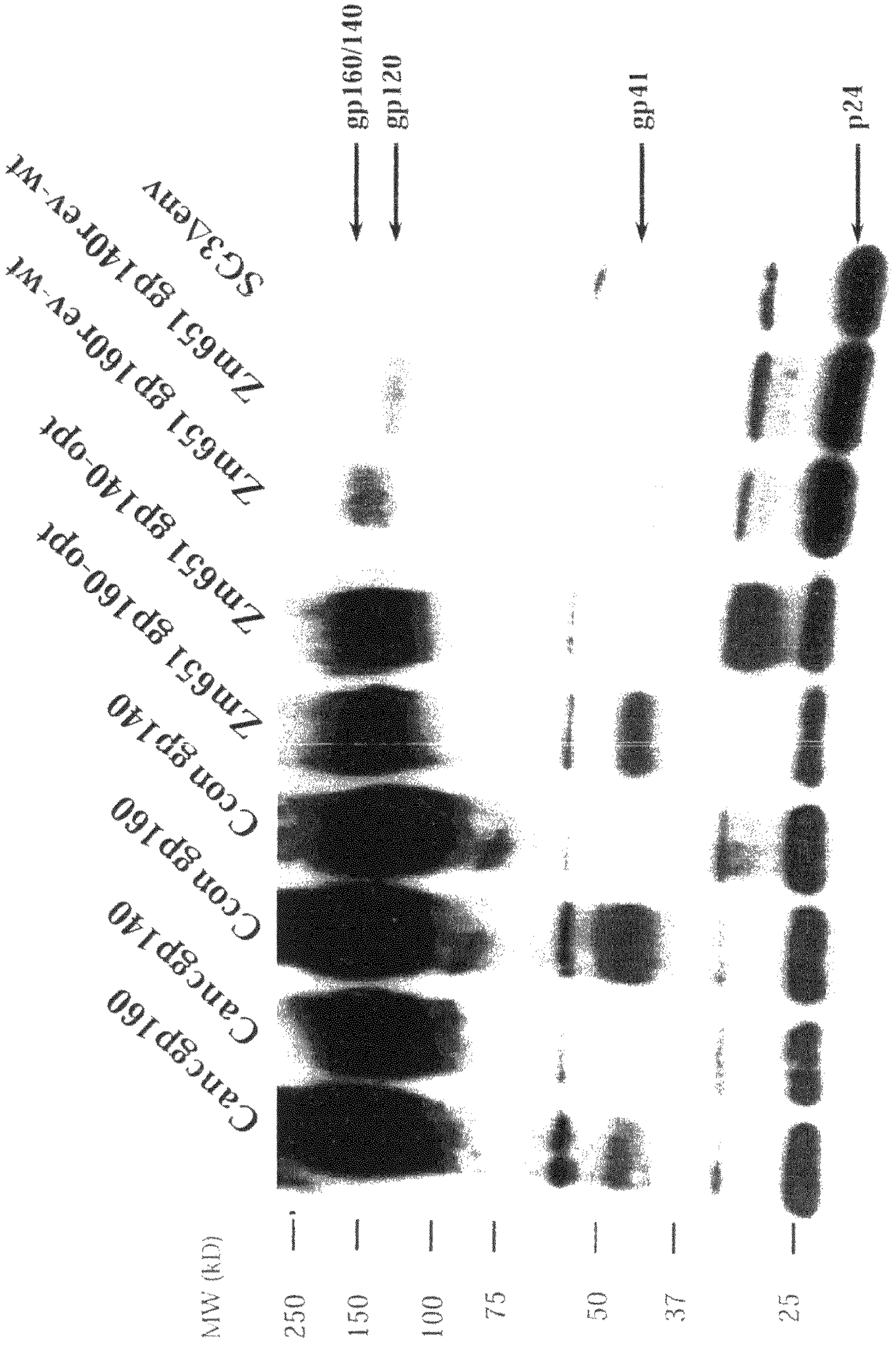
FIGS. 10A and 10B.

Codon-optimized subtype C gp160 and gp140 glycoproteins are efficiently incorporated into virus particles. Western Blot analysis of sucrose-purified pseudovirions reveals tenfold higher levels of virion incorporation of the codon-optimized envelopes compared to that of a rev-dependent contemporary envelope controls (FIG. 10A).

Figure 10B:
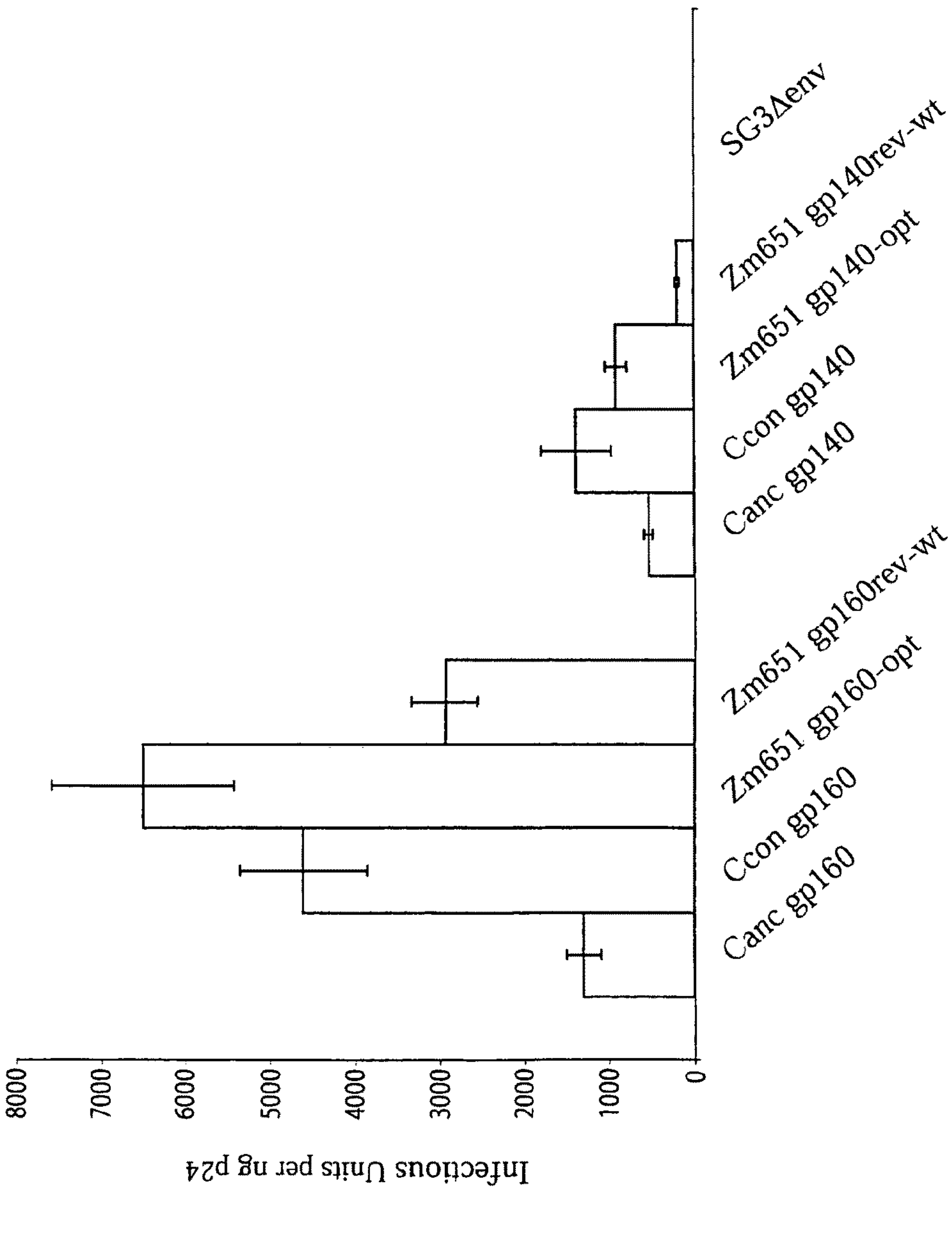

Virions pseudotyped with either the subtype C consensus gp160 or gp140 envelope were more infectious than pseudovirions containing the corresponding gp160 and gp140 ancestral envelopes. Additionally, gp160 envelopes were consistently more infectious than their respective gp140 counterparts (FIG. 10B).

Figure 11:
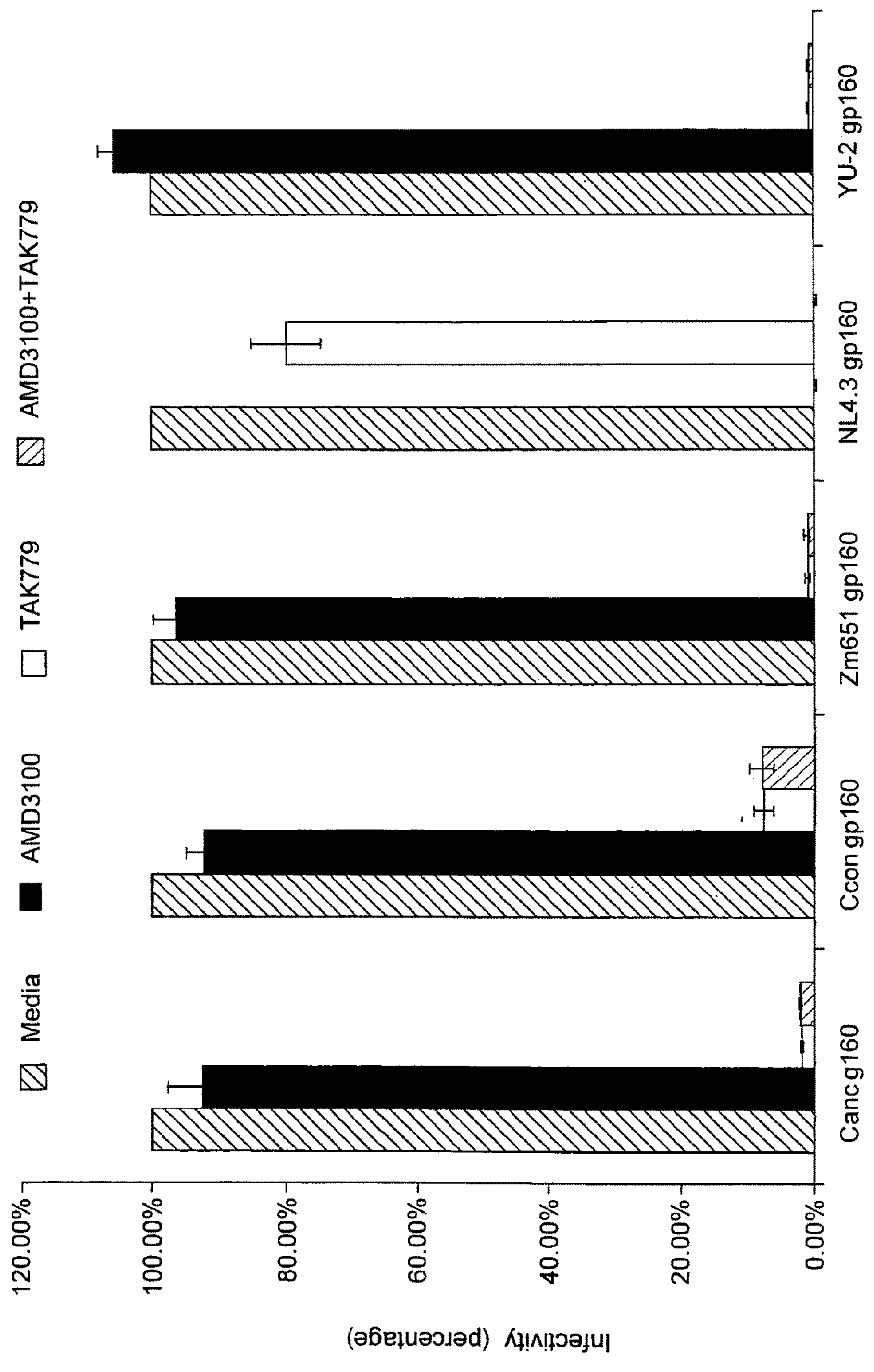
FIG. 11. Co-receptor usage of subtype C ancestral and consensus envelopes. Pseudotyped particles containing ancestral or consensus envelope were incubated with DEAE-Dextran treated JC53-BL cells in the presence of AMD3100 (a specific inhibitor of CXCR4), TAK779 (a specific inhibitor of CCR5), or AMD3000+TAK779 to determine co-receptor usage. NL4.3, an isolate known to utilize CXCR4, and YU-2, a known CCR5-using isolate, were included as controls.

Both subtype C ancestral and consensus envelopes utilize CCR5 as a co-receptor to mediate virus entry (FIG. 11).

Figures 12A, 12B:
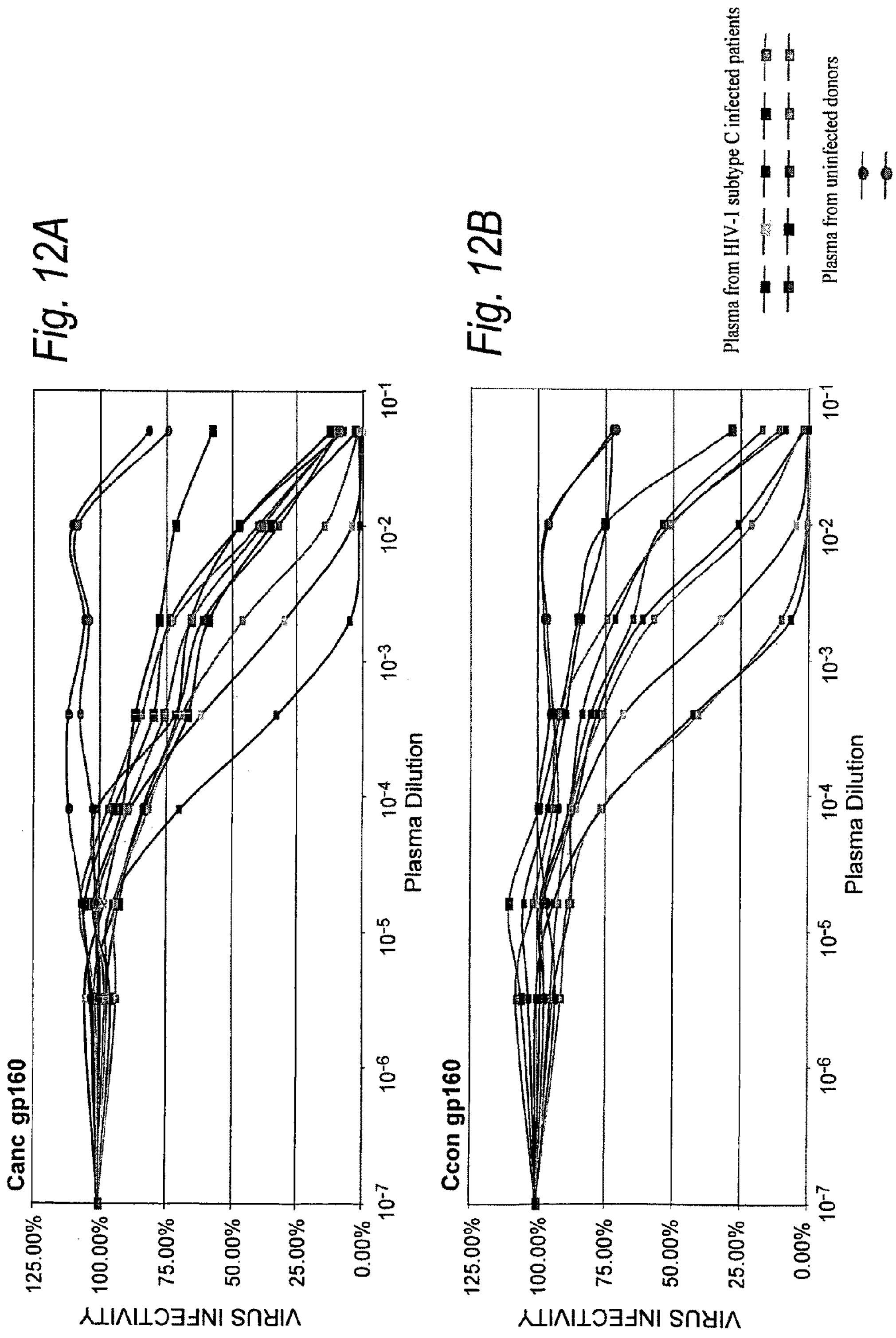
FIGS. 12A-12C. Neutralization sensitivity of subtype C ancestral and consensus envelope glycoproteins. Equivalent amounts of pseudovirions containing the ancestral, consensus or 96ZAM651 gp160 envelopes (1,500 infectious units) were pre-incubated with a panel of plasma samples from HIV-1 subtype C infected patients and then added to the JC53-BL cell monolayer in 96-well plates. Plates were cultured for two days and luciferase activity was measured as an indicator of viral infectivity. Virus infectivity is calculated by dividing the luciferase units (LU) produced at each concentration of antibody by the LU produced by the control infection. The mean 50% inhibitory concentration ($IC_{50}$) and the actual % neutralization at each antibody dilution are then calculated for each virus. The results of all luciferase experiments are confirmed by direct counting of blue foci in parallel infections.
Figure 12C:
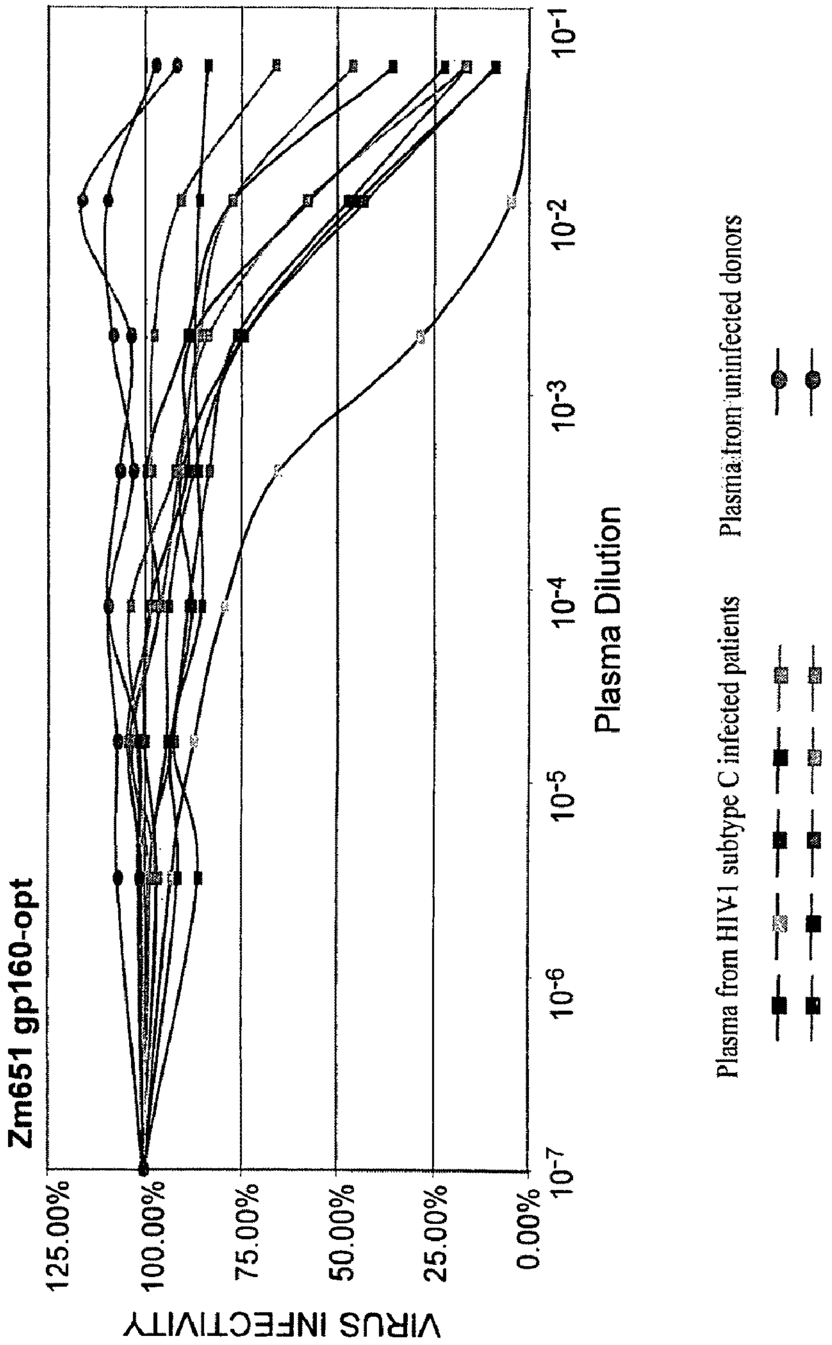

The infectivity of subtype C ancestral and consensus gp160 containing pseudovirions was neutralized by plasma from subtype C infected patients. This suggests that these artificial envelopes possess a structure that is similar to that of native HIV-1 env glycoproteins and that common neutralization epitopes are conserved. No significant differences in neutralization potential were noted between subtype C ancestral and consensus env glycoproteins (gp160) (FIG. 12).

Conclusions

HIV-1 subtype C viruses are among the most prevalent circulating isolates, representing approximately fifty percent of new infections worldwide. Genetic diversity among globally circulating HIV-1 strains poses a challenge for vaccine design. Although HIV-1 Env protein is highly variable, it can induce both humoral and cellular immune responses in the infected host. By analyzing 70 HIV-1 complete subtype C env sequences, consensus and ancestral subtype C env genes have been generated. Both sequences are roughly equidistant from contemporary subtype C strains and thus expected to induce better cross-protective immunity. A reconstructed ancestral or consensus sequence derived-immunogen minimizes the extent of genetic differences between the vaccine candidate and contemporary isolates. However, consensus and ancestral subtype C env genes differ by 5% amino acid sequences. Both consensus and ancestral sequences have been synthesized for analyses. Codon-optimized subtype C ancestral and consensus envelope genes have been constructed and the in vitro biological properties of the expressed glycoproteins determined. Synthetic subtype C consensus and ancestral env genes express glycoproteins that are similar in their structure, function and antigenicity to contemporary subtype C wild-type envelope glycoproteins.

EXAMPLE 3

Codon-Usage Optimization of Consensus of Subtype C gag and nef Genes (C.con.gag and C.con.nef)

Subtype C viruses have become the most prevalent viruses among all subtypes of Group M viruses in the world. More than 50% of HIV-1 infected people are currently carrying HIV-1 subtype C viruses. In addition, there is considerable intra-subtype C variability: different subtype C viruses can differ by as much as 10%, 6%, 17% and 16% of their Gag, Pol, Env and Nef proteins, respectively. Most importantly, the subtype C viruses from one country can vary as much as the viruses isolated from other parts of the world. The only exceptions are HIV-1 strains from India/China, Brazil and Ethiopia/Djibouti where subtype C appears to have been introduced more recently. Due to the high genetic variability of subtype C viruses even within a single country, an immunogen based on a single virus isolate may not elicit protective immunity against other isolates circulating in the same area.

Thus gag and nef gene sequences of subtype C viruses were gathered to generate consensus sequences for both genes by using a 50% consensus threshold. To avoid a potential bias toward founder viruses, only one sequence was used from India/China, Brazil and Ethiopia/Djibouti, respectively, to generate the subtype C consensus sequences (C.con.gag and C.con.nef). The codons of both C.con.gag and C.con.nef genes were optimized based on the codon usage of highly expressed human genes. The protein expression following transfection into 293T cells is shown in FIG. 13. As can be seen, both consensus subtype C Gag and Nef proteins were expressed efficiently and recognized by Gag- and Nef-specific antibodies. The protein expression levels of both C.con.gag and C.con.nef genes are comparable to that of native subtype env gene (96ZM651).

EXAMPLE 4

Synthesis of a Full Length “Consensus of the Consensus env Gene with Consensus Variable Regions” (CON-S)

In the synthesized “consensus of the consensus” env gene (CON6), the variable regions were replaced with the corresponding regions from a contemporary subtype C virus (98CN006). A further con/con gene has been designed that also has consensus variable regions (CON-s). The codons of the Con-S env gene were optimized based on the codon usage of highly expressed human genes. (See FIGS. 14A and 14B for amino acid sequences and nucleic acid sequences, respectfully.)

Paired oligonucleotides (80-mers) which overlap by 20 bp at their 3' ends and contain invariant sequences at their 5' and 3' ends, including the restriction enzyme sites EcoRI and BbsI as well as BsmBI and BamHI, respectively, were designed. BbsI and BamHI are Type II restriction enzymes that cleave outside of their recognition sequences. They have been positioned in the oligomers in such a way that they cleave the first four resides adjacent to the 18 bp invariant region, leaving 4 base 5' overhangs at the end of each fragment for the following ligation step. 26 paired oligomers were linked individually using PCR and primers complimentary to the 18 bp invariant sequences. Each pair was cloned into pGEM-T (Promega) using the T/A cloning method and sequenced to confirm the absence of inadvertent mutations/deletions. pGEM-T subclones containing the proper inserts were then digested, run on a 1% agarose gel, and gel purified (Qiagen). Four individual 108-mers were ligated into pcDNA3.1 (Invitrogen) in a multi-fragment ligation reaction. The four-way ligations occurred among groups of fragments in a stepwise manner from the 5' to the 3' end of the gene. This process was repeated until the entire gene was reconstructed in the pcDNA3.1 vector.

A complete Con-S gene was constructed by ligating the codon usage optimized oligo pairs together. To confirm its open reading frame, an in vitro transcription and translation assay was performed. Protein products were labeled by S35-methionine during the translation step, separated on a 10% SDS-PAGE, and detected by radioautography. Expected size of the expressed Con-S gp160 was identified in 4 out of 7 clones (FIG. 14C).

Figure 15A:
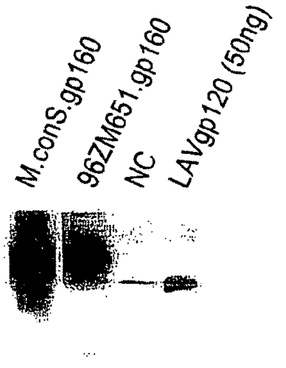
FIGS. 15A and 15B. Expression of Con-S env gene in mammalian cells.
Figure 15B:
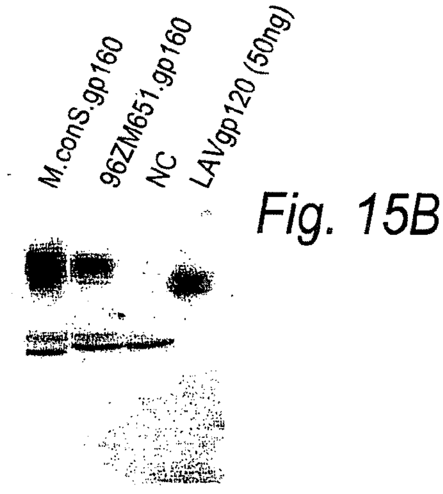

CONs Env protein expression in the mammalian cells after transfected into 293T cells using a Western blot assay (FIG. 15). The expression level of Con-S Env protein is very similar to what was observed from the previous CON6 env clone that contains the consensus conservative regions and variable loops from 98CN006 virus isolate.

Figure 16A:
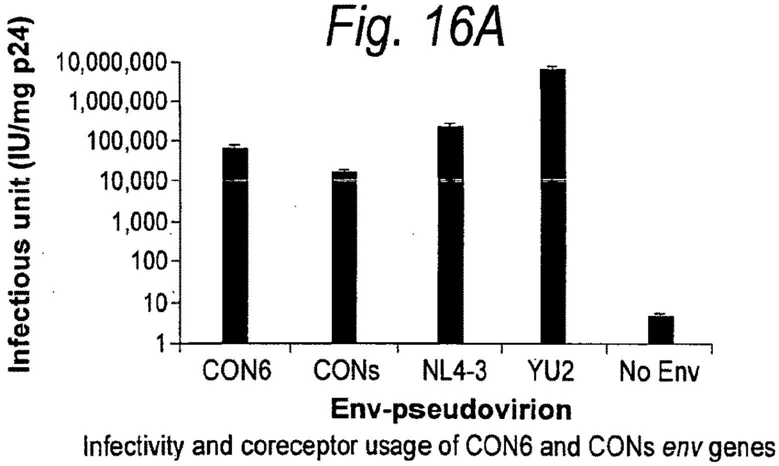
FIGS. 16A and 16B. Infectivity (FIG. 16A) and coreceptor usage (FIG. 16B) of CON6 and Con-S env genes.
Figure 16B:
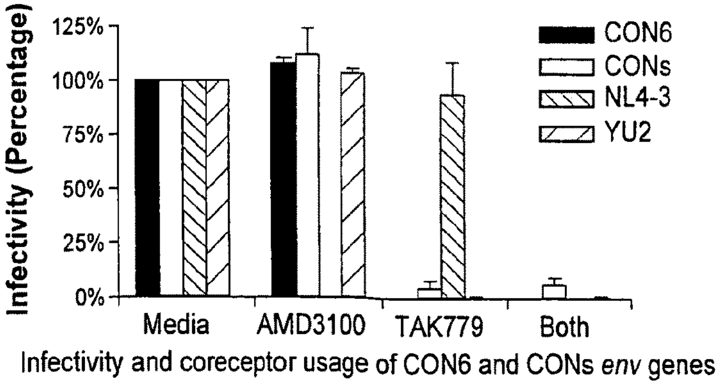

The Env-pseudovirons was produced by cotransfecting Con-S env clone and env-deficient SG3 proviral clone into 293T cells. Two days after transfection, the pseudovirions were harvested and infected into JC53BL-13 cells. The infectious units (IU) were determined by counting the blue cells after staining with X-gal in three independent experiments. When compared with CON6 env clone, Con-S env clones produce similar number of IU in JC53BL-13 cells (FIG. 16). The IU titers for both are about 3 log higher than the SG3 backbone clone control (No Env). However, the titers are also about 2 log lower than the positive control (the native HIV-1 env gene, NL4-3 or YU2). These data suggest that both consensus group M env clones are biologically functional. Their functionality, however, has been compromised. The functional consensus env genes indicate that these Env proteins fold correctly, preserve the basic conformation of the native Env proteins, and are able to be developed as universal Env immunogens.

It was next determined what coreceptor Con-S Env uses for its entry into JC53-BL cells. When treated with CXCR4 blocking agent AMD3100, the infectivity of NL4-3 Env-pseudovirons was blocked while the infectivity of YU2, Con-S or CON6 Env-pseudovirons was not inhibited. In contrast, when treated with CCR5 blocking agent TAK779, the infectivity of NL4-3 Env-pseudovirons was not affected, while the infectivity of YU2, Con-S or CON6 Env-pseudovirons was inhibited. When treated with both blocking agents, the infectivity of all pseudovirions was inhibited. Taken together, these data show that the Con-S as well as CON6 envelope uses the CCR5 but not CXCR4 co-receptor for its entry into target cells.

Figure 17B:
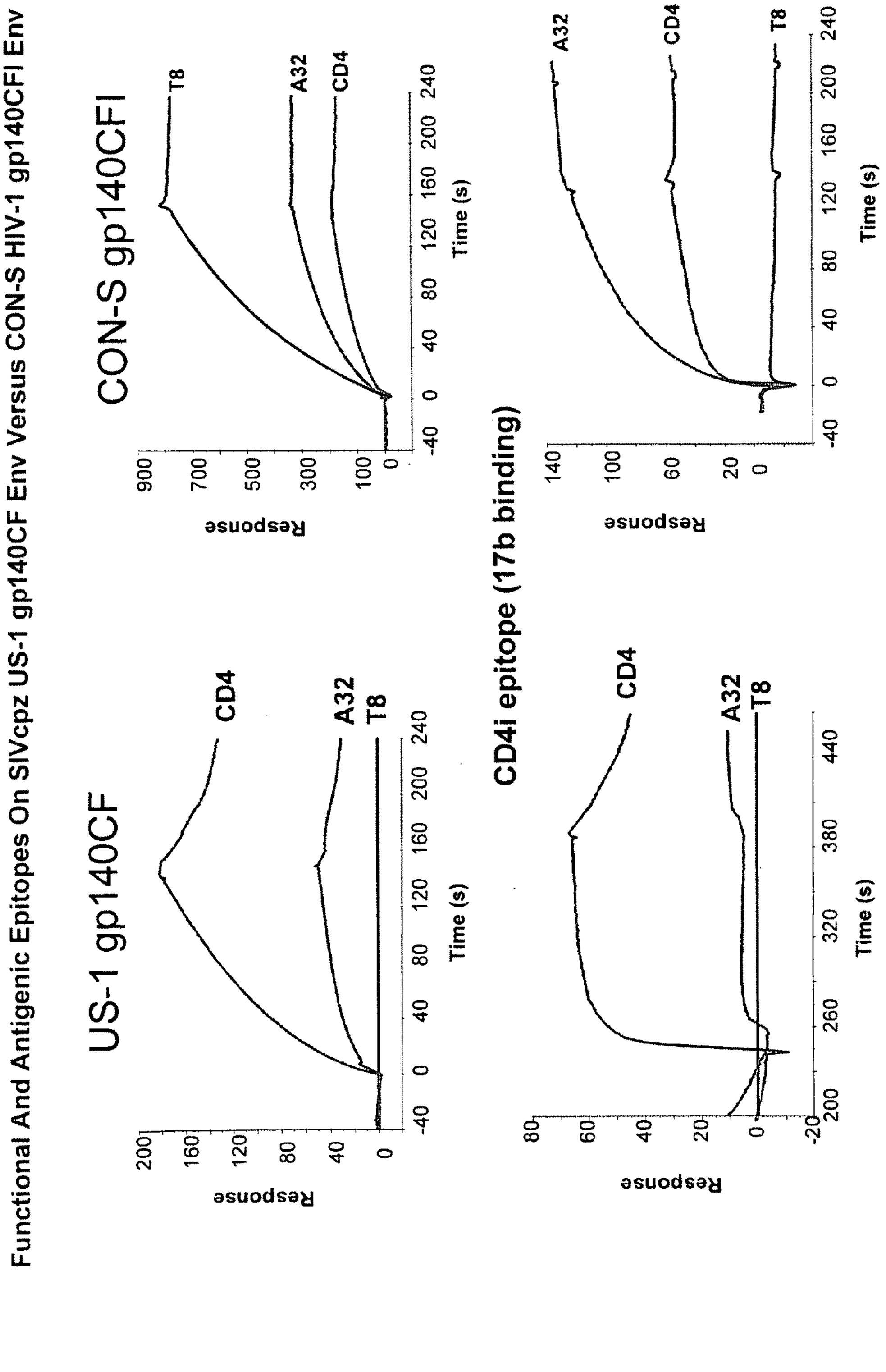
FIGS. 17A-17C. Env protein incorporation in CON6 and Con-S Env-pseudovirions.
Figure 128:
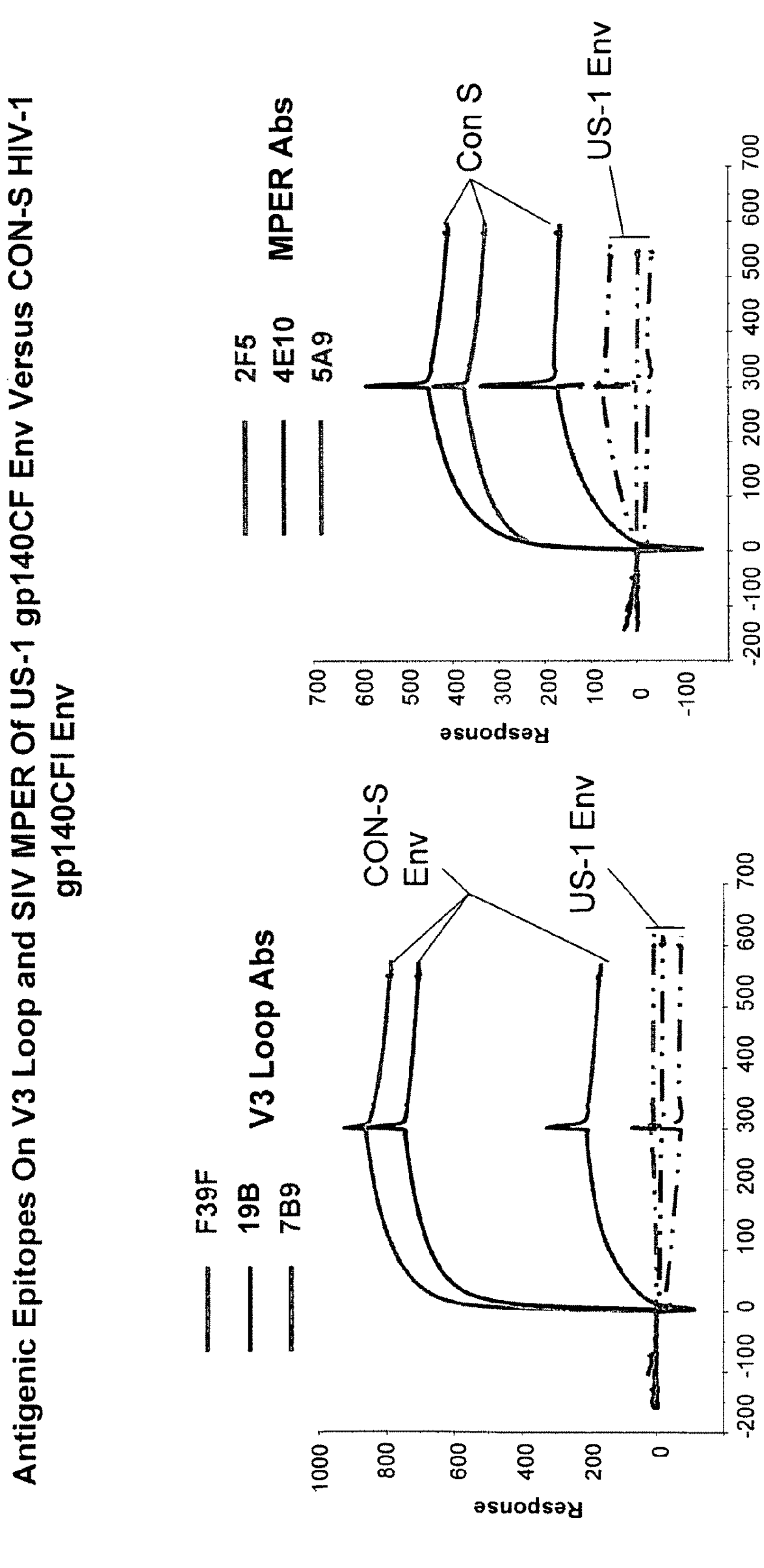
Figure 17Q:
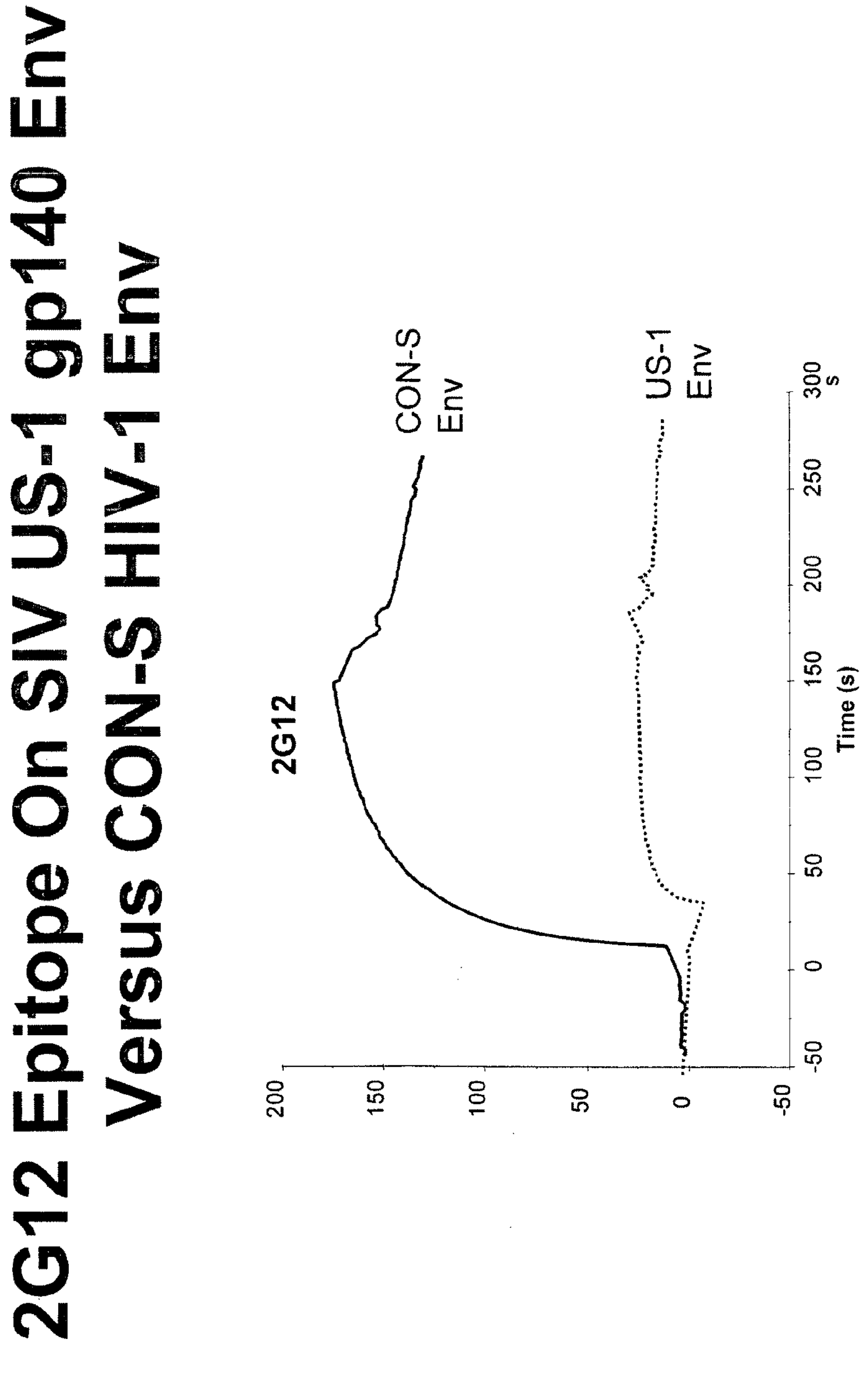
Figure 128:
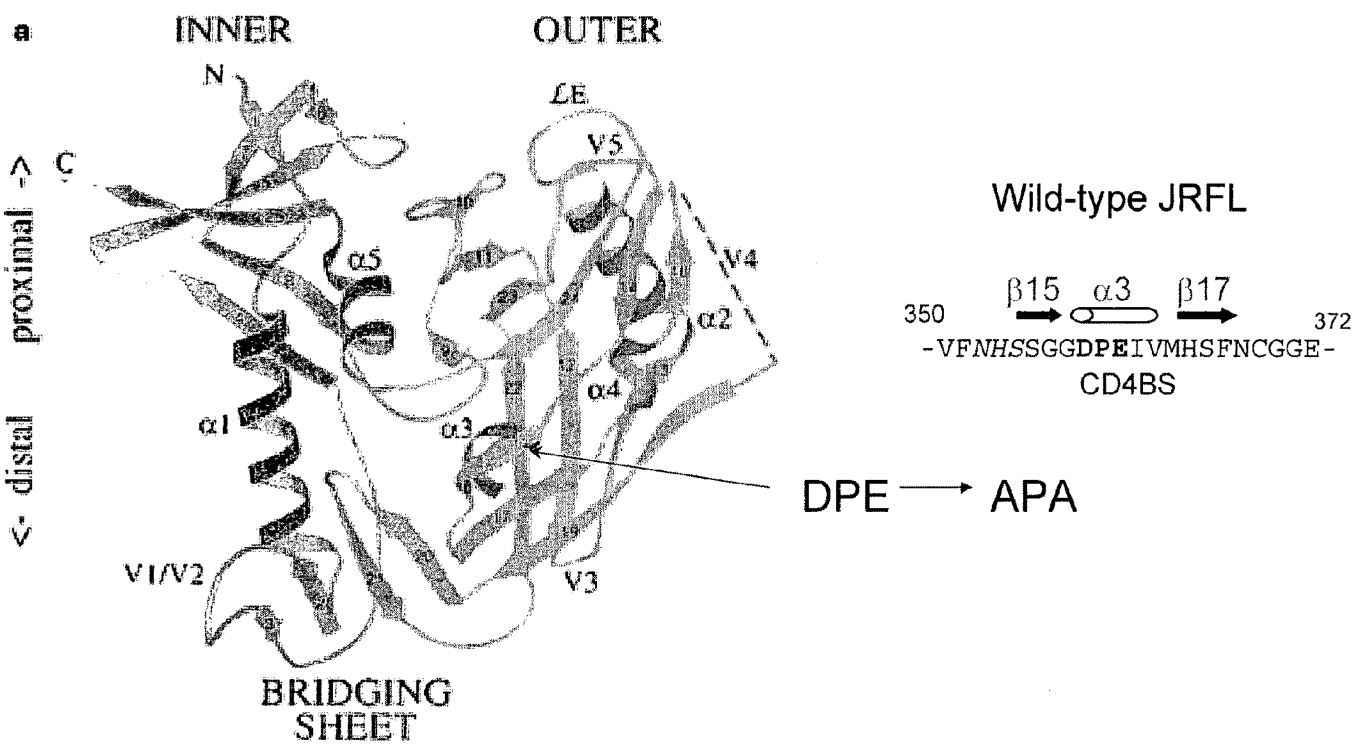
Figure 128:
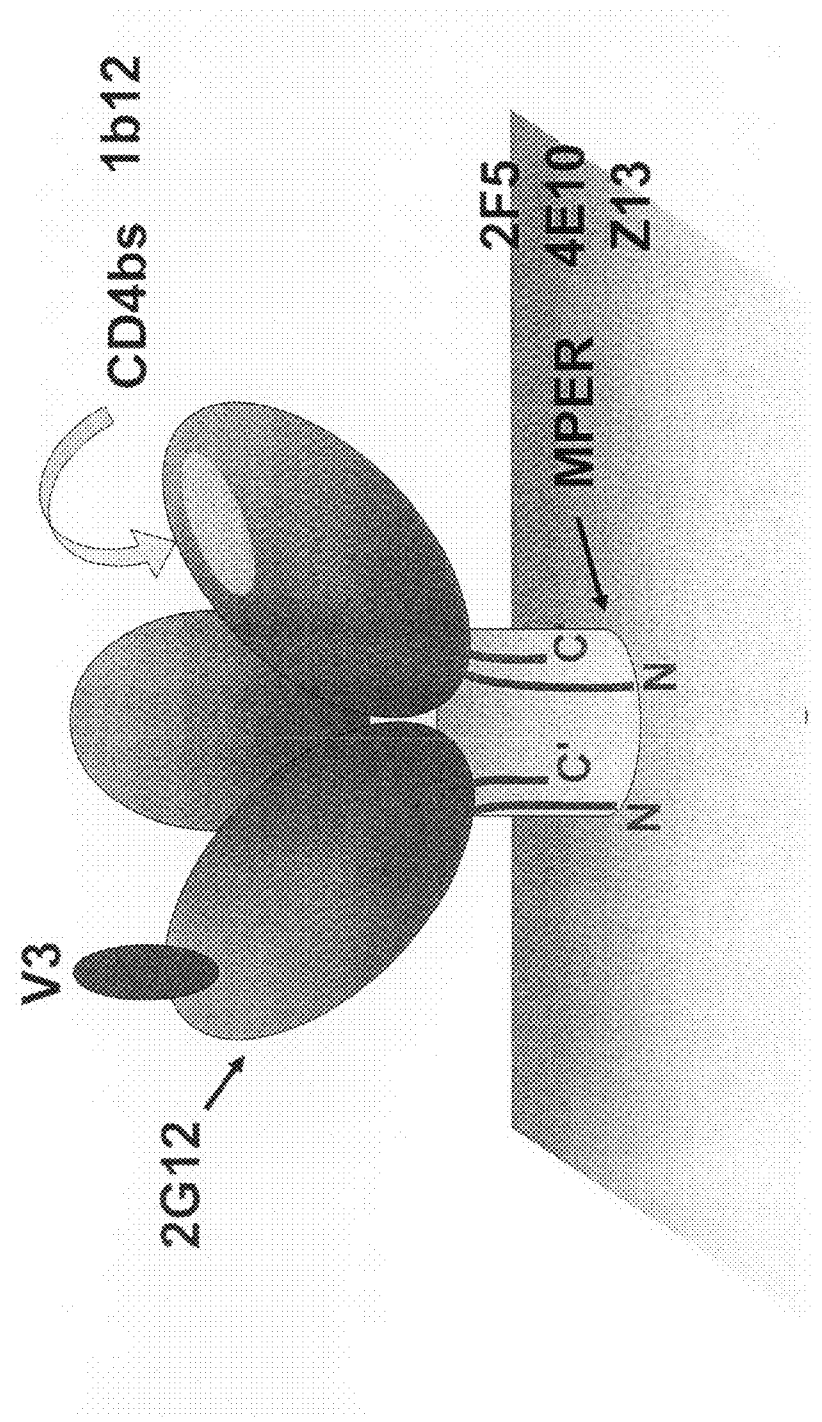
Figure 178:
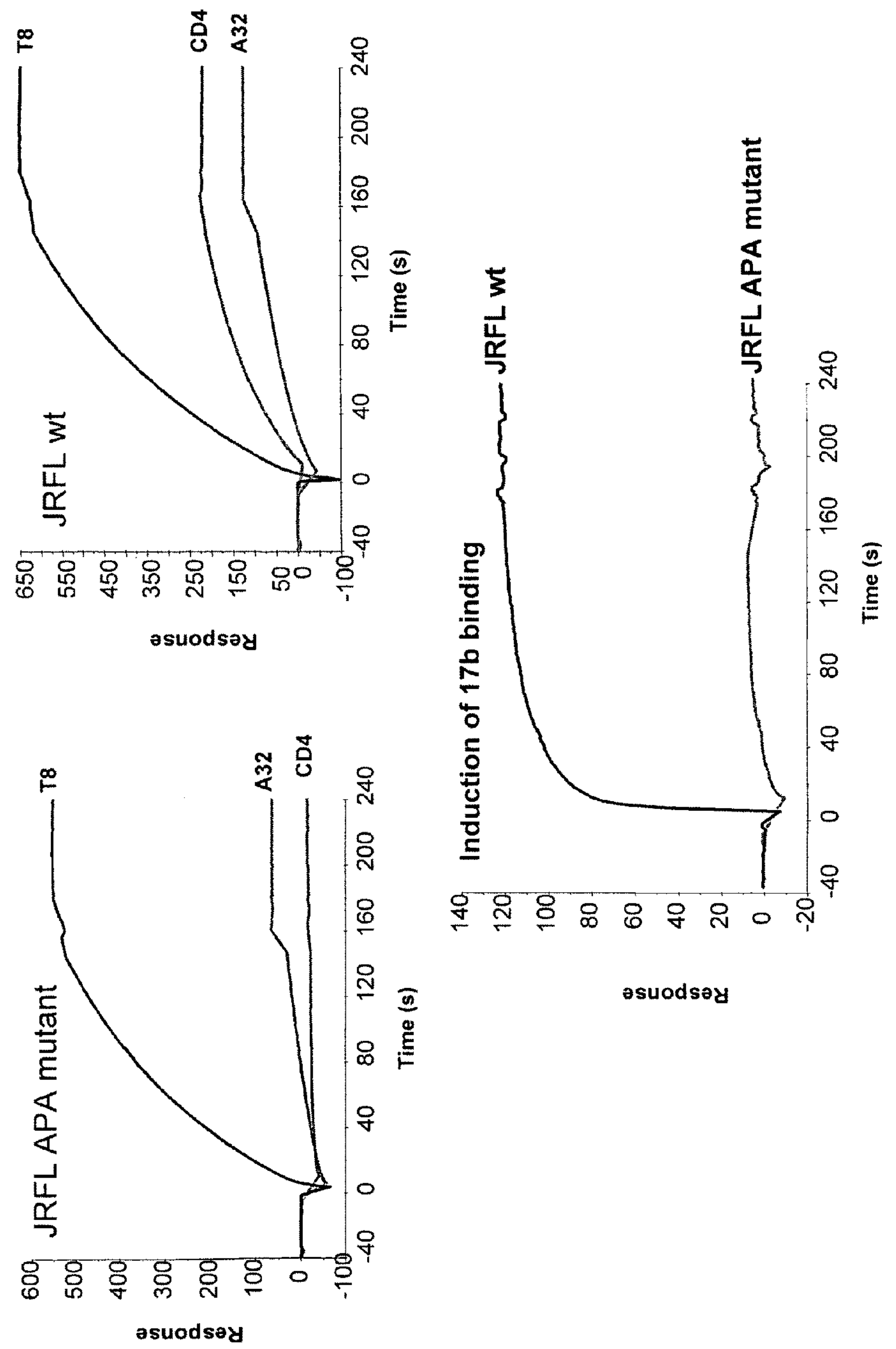
Figure 128:
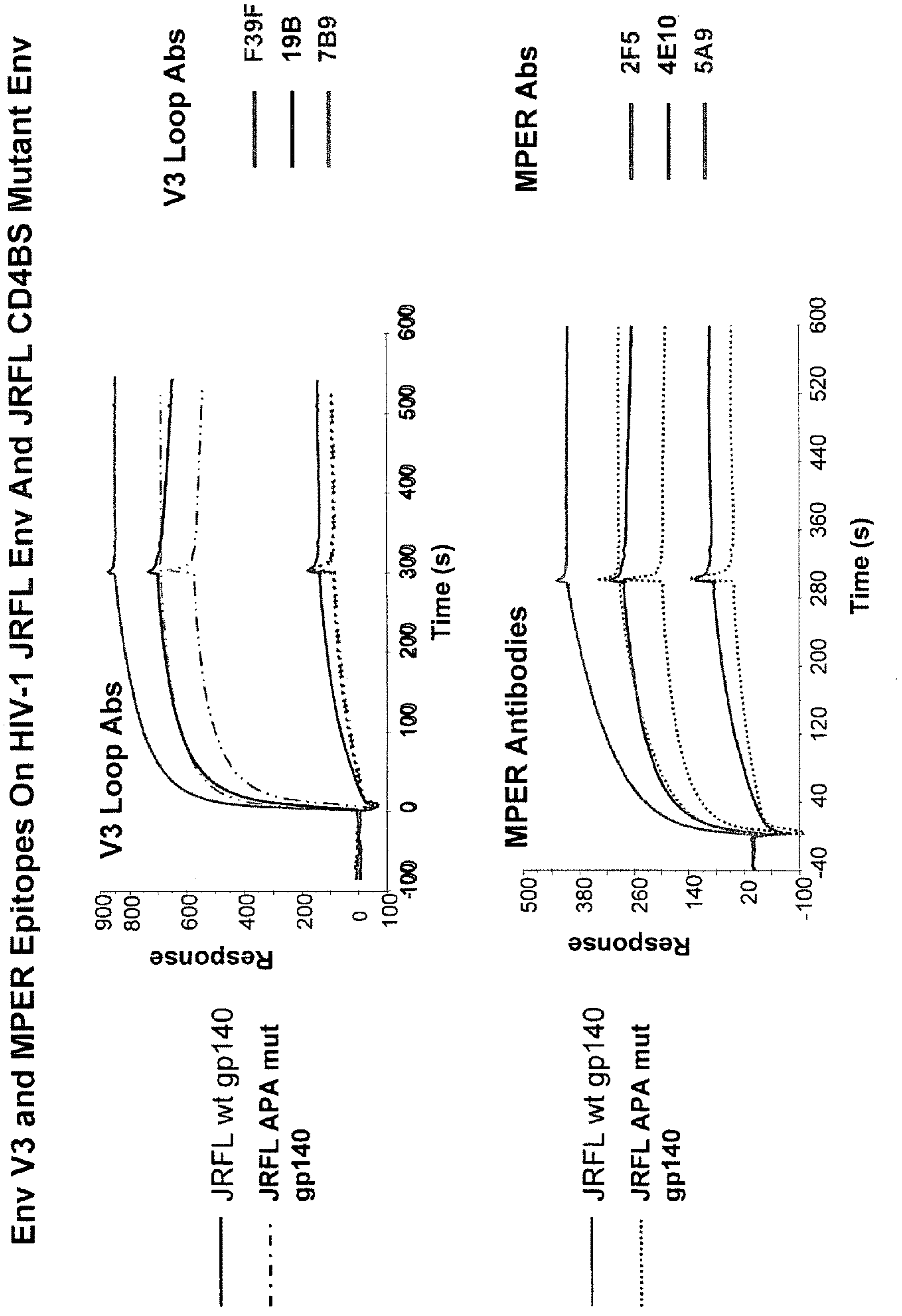
Figure 128:
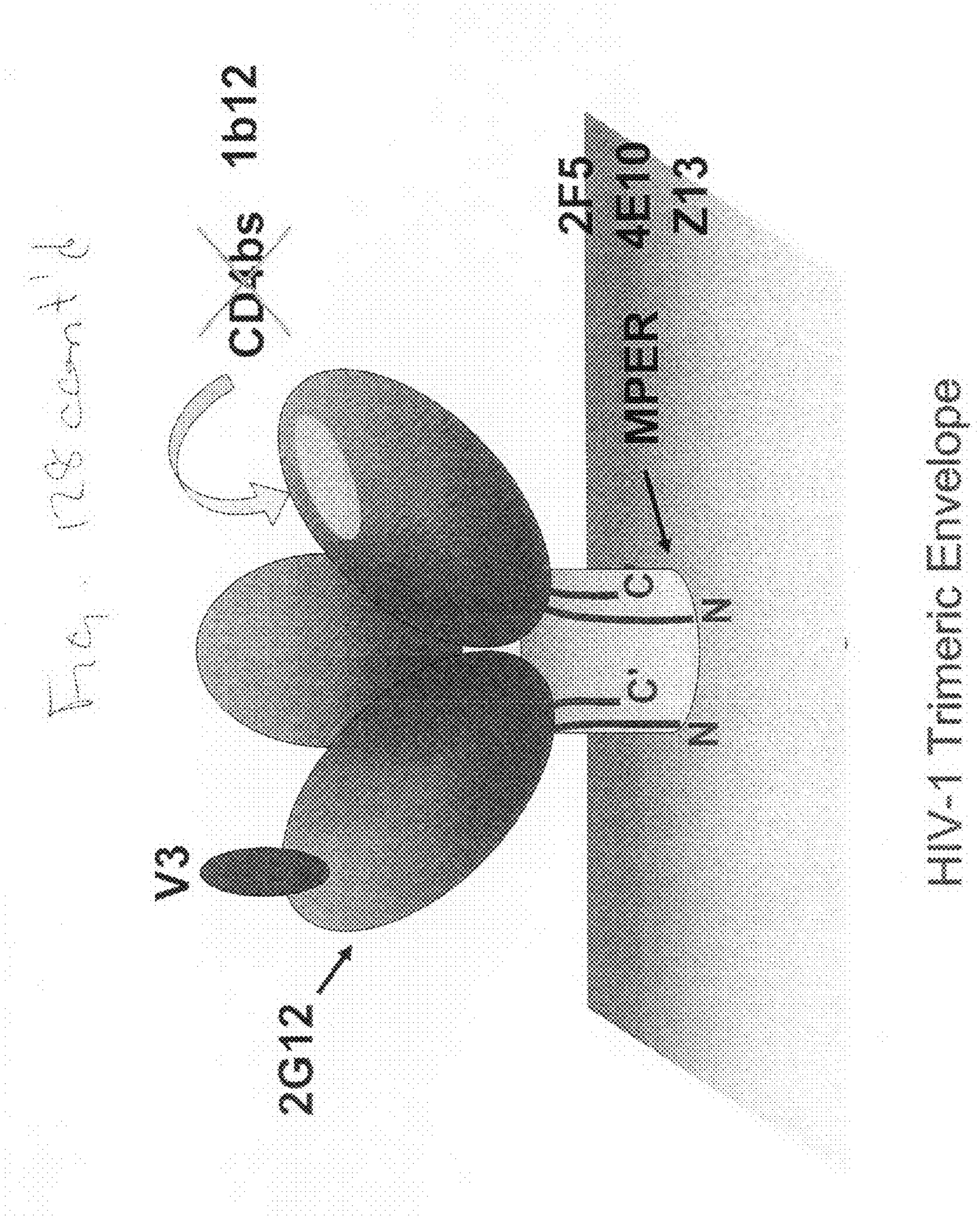
Figure 128:
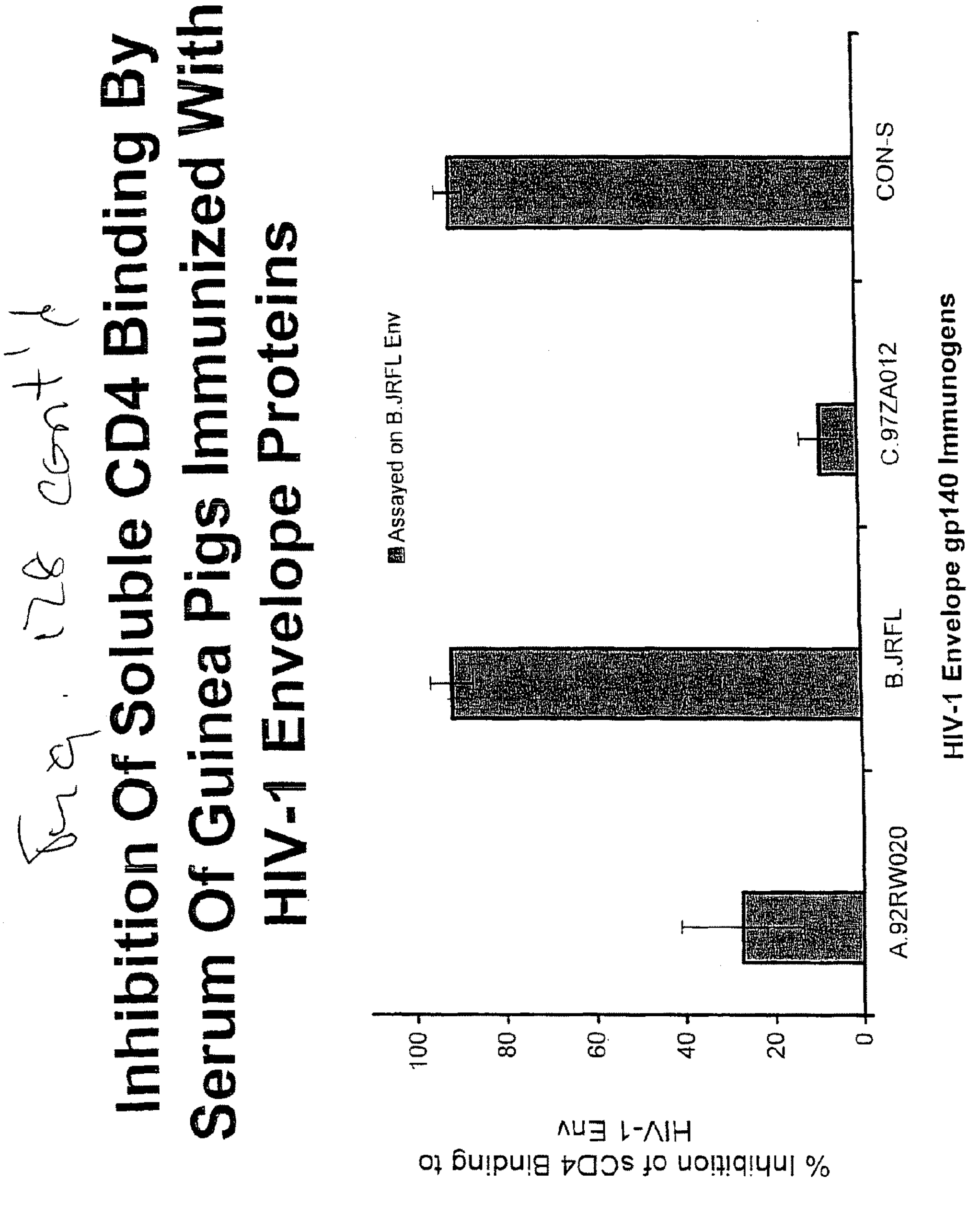
Figure 128:
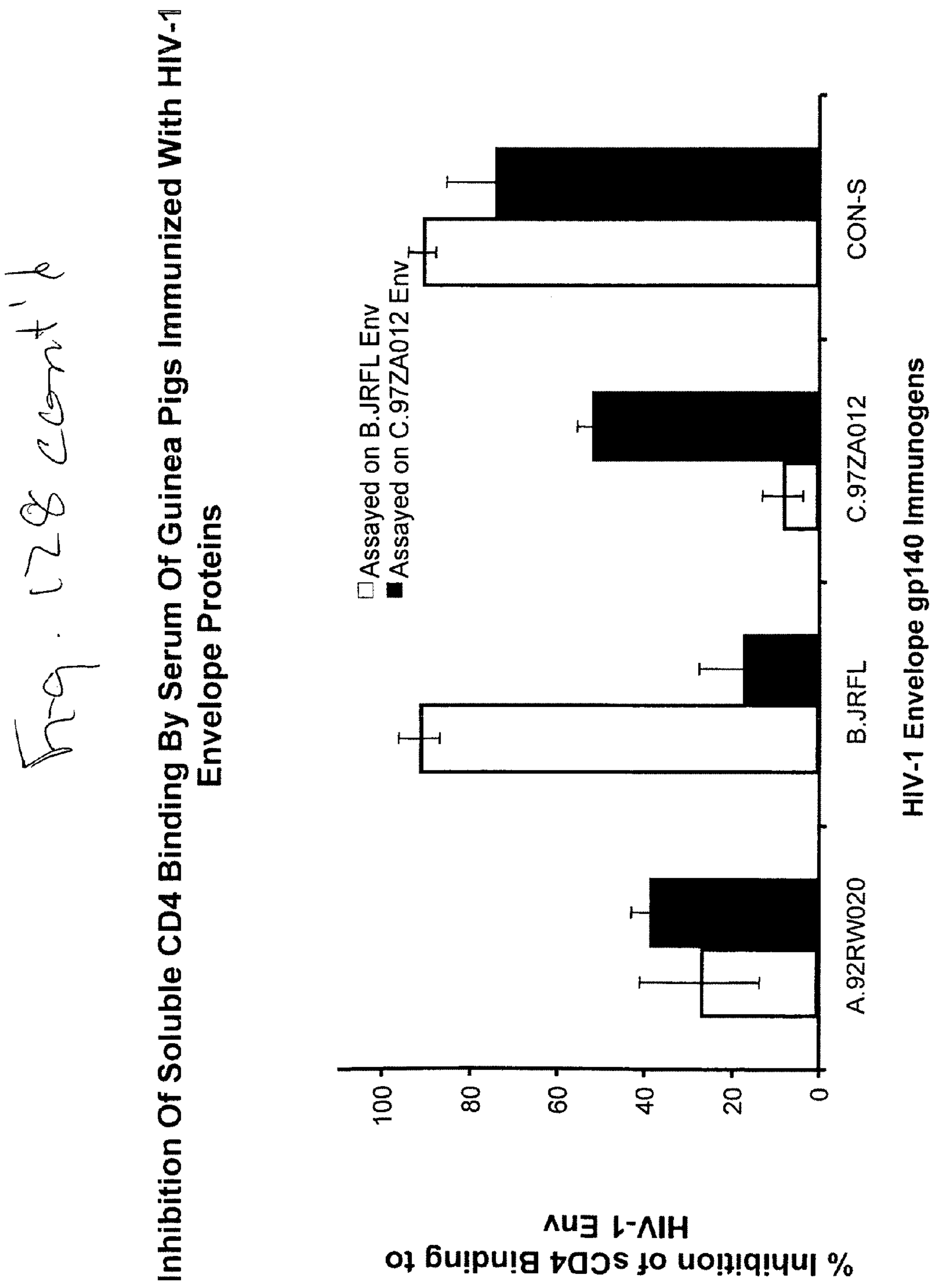
Figure 178:
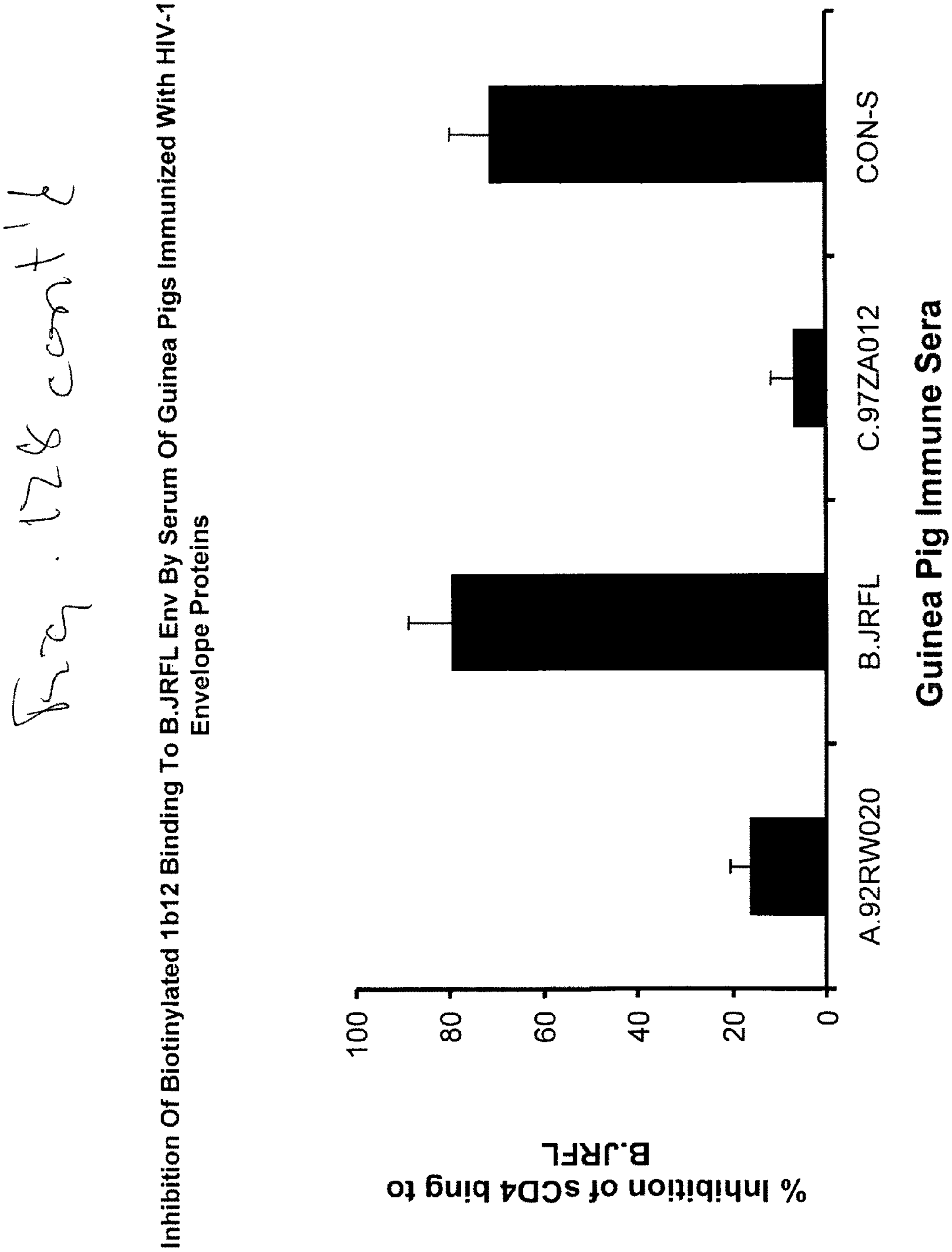
Figure 128:
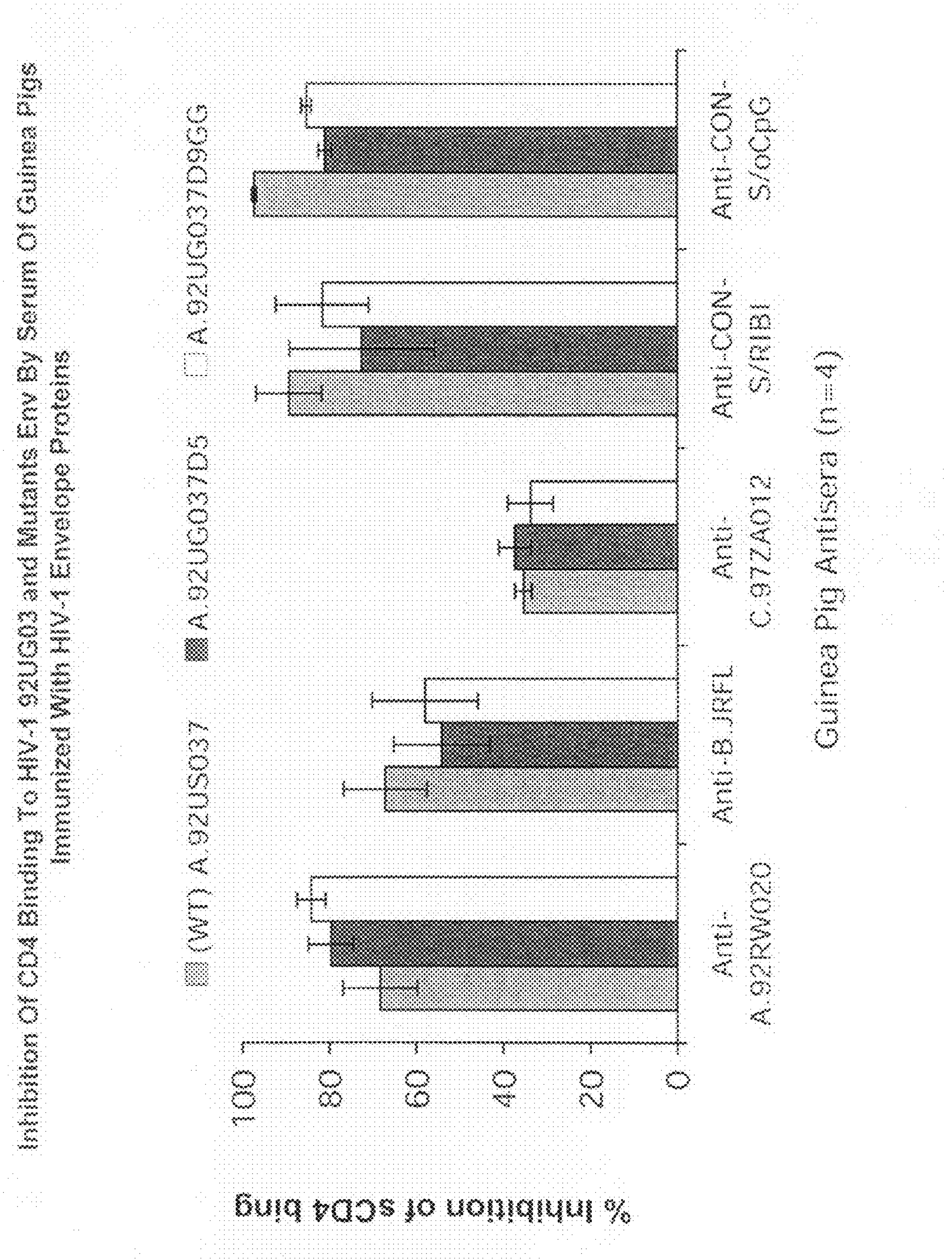
Figure 178:
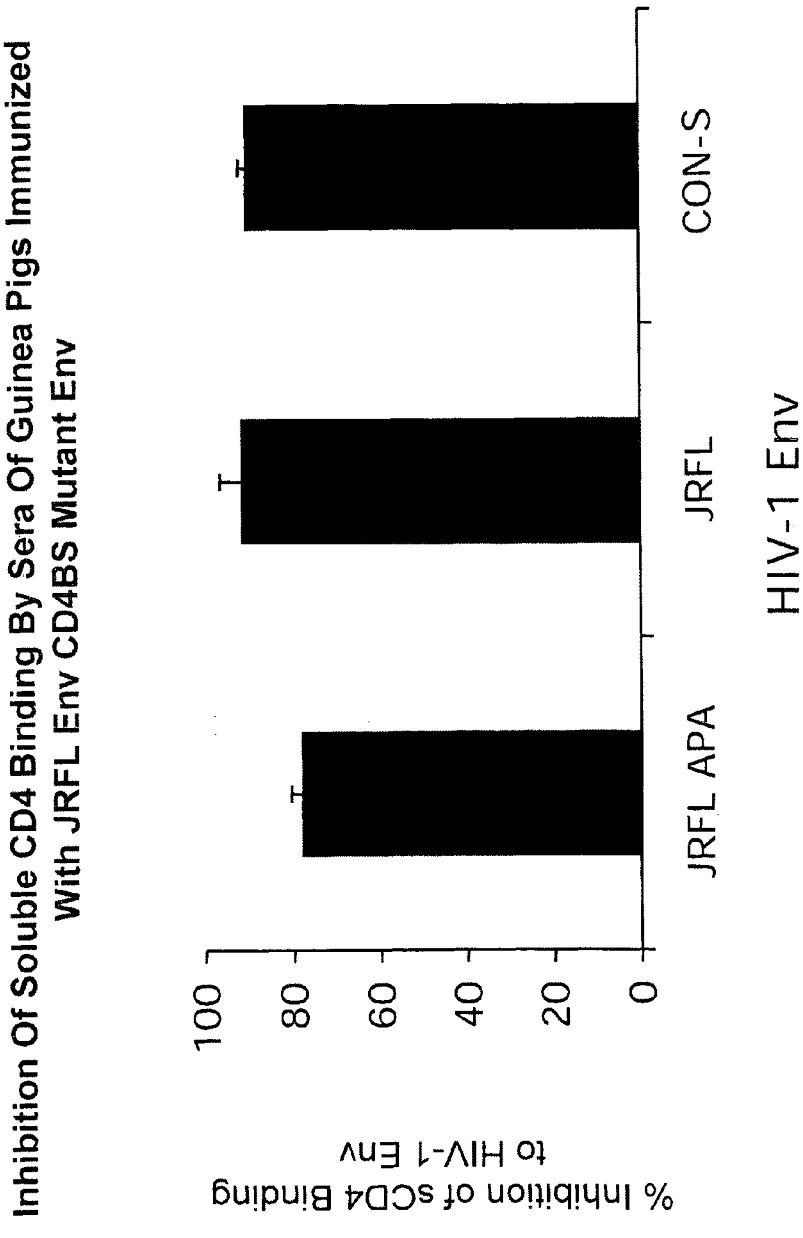
Figure 128:
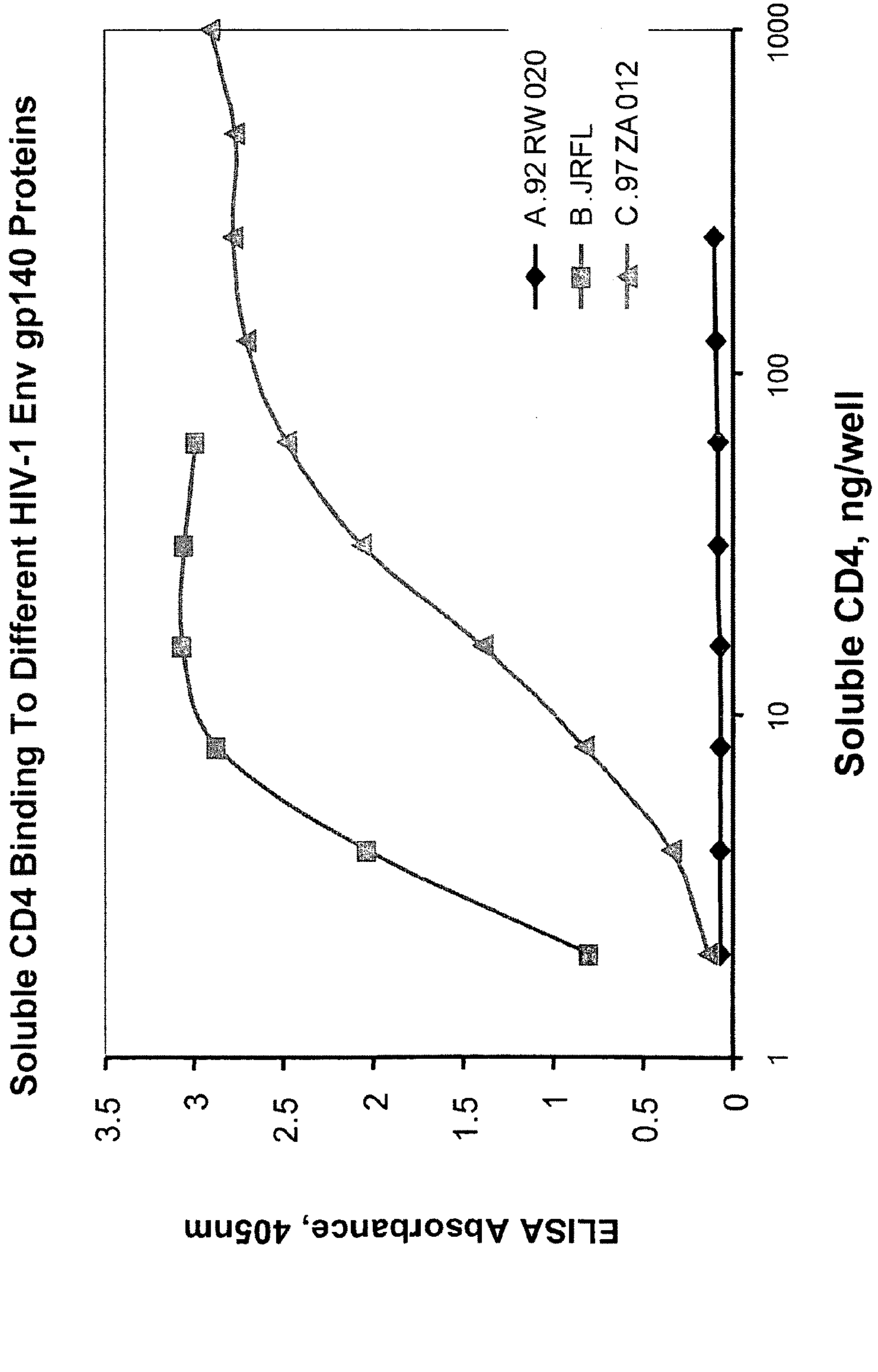
Figure 178:
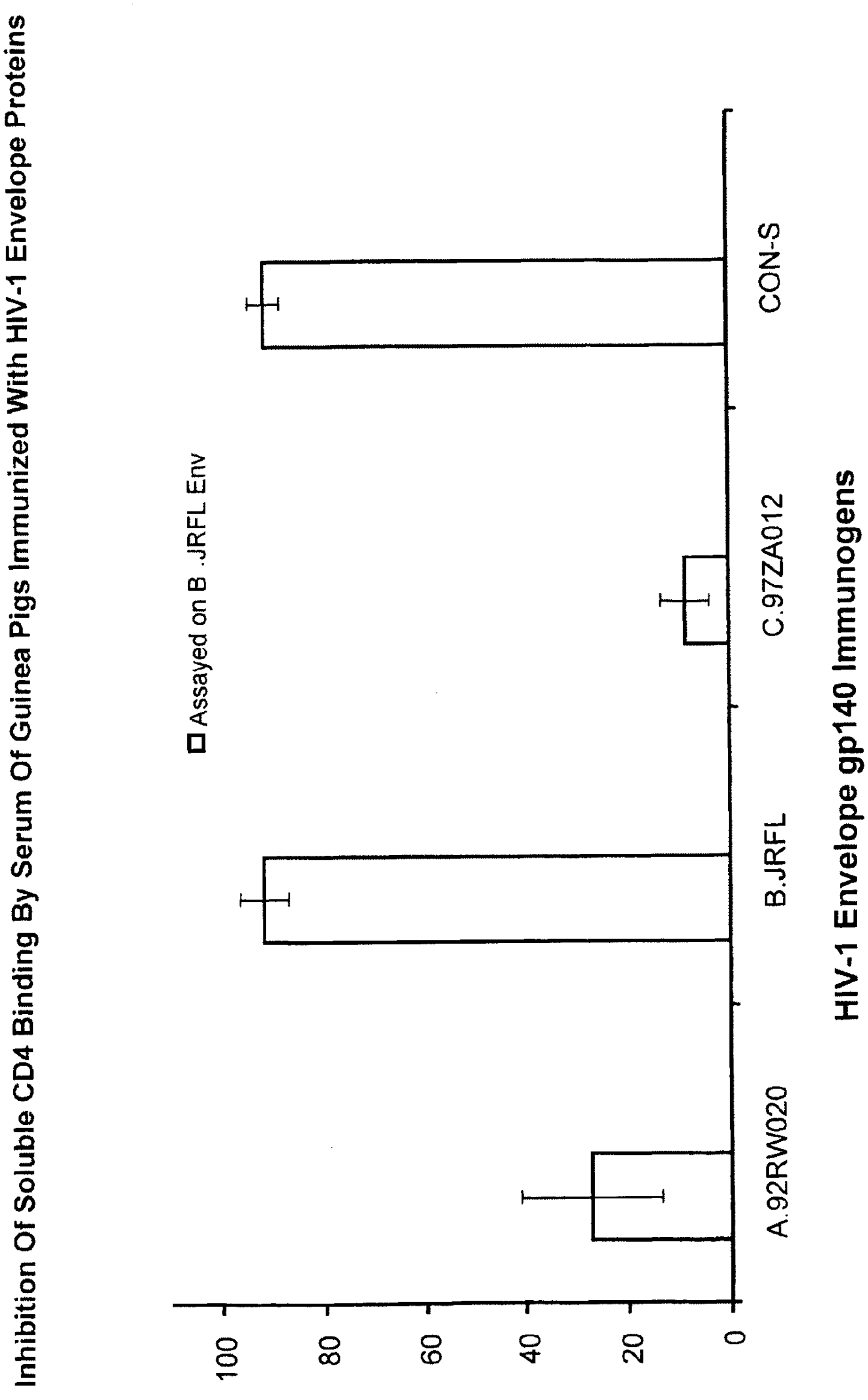

It was next determined whether CON6 or Con-S Env proteins could be equally efficiently incorporated in to the pseudovirions. To be able precisely compare how much Env proteins were incorporated into the pseudovirions, each pseudovirions is loaded on SDS-PAGE at the same concentration: 5 μg total protein for cell lysate, 25 ng p24 for cell culture supernatant, or 150 ng p24 for purified virus stock (concentrated pseudovirions after super-speed centrifugation). There was no difference in amounts of Env proteins incorporated in CON6 or Con-S Env-pseudovirions in any preparations (cell lysate, cell culture supernatant or purified virus stock) (FIG. 17).

EXAMPLE 5

Synthesis of a Consensus Subtype A Full Length env (A.con.env) Gene

Subtype A viruses are the second most prevalent HIV-1 in the African continent where over 70% of HIV-1 infections have been documented. Consensus gag, env and nef genes for subtype C viruses that are the most prevalent viruses in Africa and in the world were previously generated. Since genetic distances between subtype A and C viruses are as high as 30% in the env gene, the cross reactivity or protection between both subtypes will not be optimal. Two group M consensus env genes for all subtypes were also generated. However, to target any particular subtype viruses, the subtype specific consensus genes will be more effective since the genetic distances between subtype consensus genes and field viruses from the same subtype will be smaller than that between group M consensus genes and these same viruses. Therefore, consensus genes need to be generated for development of subtype A specific immunogens. The codons of the A.con.env gene were optimized based on the codon usage of highly expressed human genes. (See FIGS. 18A and 18B for amino acid and nucleic acid sequences, respectively.)

Each pair of the oligos has been amplified, cloned, ligated and sequenced. After the open reading frame of the A.con env gene was confirmed by an in vitro transcription and translation system, the A.con env gene was transfected into the 293T cells and the protein expression and specificity confirmed with the Western blot assay (FIG. 18). It was then determined whether A.con envelope is biologically functional. It was co-transfected with the env-defective SG3 proviral clone into 293T cells. The pseudotyped viruses were harvested and used to infect JC53BL cells. Blue cells were detected in JC53-BL cells infected with the A.con Env-pseudovirions, suggesting that A.con Env protein is biologically functional (Table 6). However, the infectious titer of A.con Env-psuedovirions was about 7-fold lower than that of pseudovirions with wild-type subtype C envelope (Table 6). Taken together, the biological function A.con Env proteins suggests that it folds correctly and may induce linear and conformational T and B cell epitopes if used as an Env immunogen.

TABLE 6

Infectivity of pseudovirons with A. con env genes

| | JC53BL13 (IU/ul) | | |
|---|---|---|---|
| | Mar. 31, 2003 non filtered supt. | Apr. 7, 2003 0.22 μm filtered | Apr. 25, 2003 0.22 μm filtered |
| A. con +SG3 | 4 | 8.5 | 15.3 |
| 96ZM651 +SG3 | 87 | 133 | 104 |
| SG3 backbone | 0 | 0.07 | 0.03 |
| Neg control | 0 | 0.007 | 0 |

EXAMPLE 6

Design of Full Length "Consensus of the Consensus gag, pol and nef Genes" (M.con.gag, M.con.pol and M.con.nef) and a Subtype C Consensus pol Gene (C.con.pol)

For the group M consensus genes, two different env genes were constructed, one with virus specific variable regions (CON6) and one with consensus variable regions (Con-S). However, analysis of T cell immune responses in immunized or vaccinated animals and humans shows that the env gene normally is not a main target for T cell immune response although it is the only gene that will induce neutralizing antibody. Instead, HIV-1 Gag, Pol and Nef proteins are found to be important for inducing potent T cell immune responses. To generate a repertoire of immunogens that can induce both broader humoral and cellular immune responses for all subtypes, it may be necessary to construct other group M consensus genes other than env gene alone. "Consensus of the consensus" gag, pol and nef genes (M.con.gag., M.con.pol and M.con.nef) have been designed. To generate a subtype consensus pol gene, the subtype C consensus pol gene (C.con.pol) was also designed. The codons of the M.con.gag., M.con.pol, M.con.nef and C.con.pol. genes were optimized based on the codon usage of highly expressed human genes. (See FIG. 19 for nucleic acid and amino acid sequences.)

EXAMPLE 7

Synthetic Subtype B Consensus gag and env Genes

Experimental Details

Subtype B consensus gag and env sequences were derived from 37 and 137 contemporary HIV-1 strains, respectively, codon-usage optimized for mammalian cell expression, and synthesized (FIGS. 20A and 20B). To ensure optimal expression, a Kozak sequence (GCCGCCGCC) was inserted immediately upstream of the initiation codon. In addition to the full-length env gene, a truncated env gene was generated by introducing a stop codon immediately after the gp41 membrane-spanning domain (IVNR) to create a gp145 gene. Genes were tested for integrity in an in vitro transcription/translation system and expressed in mammalian cells. (Subtype B consensus Gag and Env sequences are set forth in FIGS. 20C and 20D, respectively.)

To determine if the subtype B consensus envelopes were capable of mediating fusion and entry, gp160 and gp145 genes were co-transfected with an HIV-1/SG3Δenv provirus and the resulting pseudovirions were tested for infectivity using the JC53-BL cell assay. JC53-BL cells are a derivative of HeLa cells that express high levels of CD4 and the HIV-1 coreceptors CCR5 and CXCR4. They also contain the reporter cassettes of luciferase and β-galactosidase that are each expressed from an HIV-1 LTR. Expression of the reporter genes is dependent on production of HIV-1 Tat. Briefly, cells are seeded into 24-well plates, incubated at 37° C. for 24 hours and treated with DEAE-Dextran at 37° C. for 30 min. Virus is serially diluted in 1% DMEM, added to the cells incubating in DEAE-dextran, and allowed to incubate for 3 hours at 37° C. after which an additional 500 μL of cell media is added to each well. Following a final 48-hour incubation at 37° C., cells are fixed, stained using X-Gal, and overlaid with PBS for microscopic counting of blue foci. Counts for mock-infected wells, used to determine background, are subtracted from counts for the sample wells. Co-receptor usage and envelope neutralization sensitivity were also determined with slight modifications of the JC53-BL assay.

To determine whether the subtype B consensus Gag protein was capable of producing virus-like particles (VLPs) that incorporated Env glycoproteins, 293T cells were co-transfected with subtype B consensus gag and env genes. 48-hours post-transfection, cell supernatants containing VLPs were collected, clarified in a tabletop centrifuge, filtered through a 0.2 mM filter, and pellet through a 20% sucrose cushion. The VLP pellet was resuspended in PBS and transferred onto a 20-60% continuous sucrose gradient. Following overnight centrifugation at 100,000×g, 0.5 ml fractions were collected and assayed for p24 content. The refractive index of each fraction was also measured. Fractions with the correct density for VLPs and containing the highest levels of p24 were pooled and pellet a final time. VLP-containing pellets were re-suspended in PBS and loaded on a 4-20% SDS-PAGE gel. Proteins were transferred to a PVDF membrane and probed with serum from a subtype B HIV-1 infected individual.

Results

Figure 21:
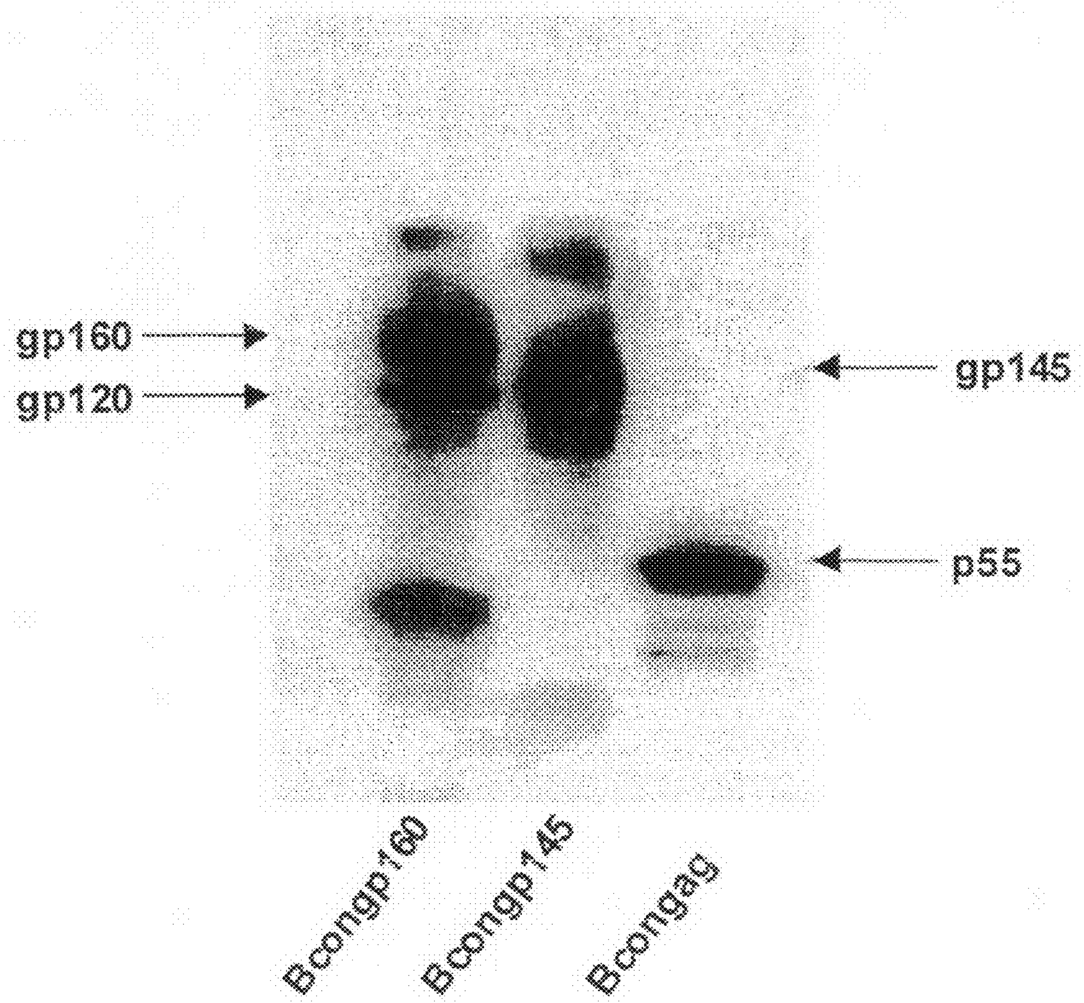
FIG. 21. Expression of subtype B consensus env and gag genes in 293T cells. Plasmids containing codon-optimized subtype B consensus gp160, gp140, and gag genes were transfected into 293T cells, and protein expression was examined by Western Blot analysis of cell lysates. 48-hours post-transfection, cell lysates were collected, total protein content determined by the BCA protein assay, and 2 μg of total protein was loaded per lane on a 4-20% SDS-PAGE gel. Proteins were transferred to a PVDF membrane and probed with serum from an HIV-1 subtype B infected individual.

Codon-usage optimized, subtype B consensus envelope (gp160, gp145) and gag genes express high levels of glycoprotein in mammalian cells (FIG. 21).

Subtype B gp160 and gp145 glycoproteins are efficiently incorporated into virus particles.

Figure 23A:
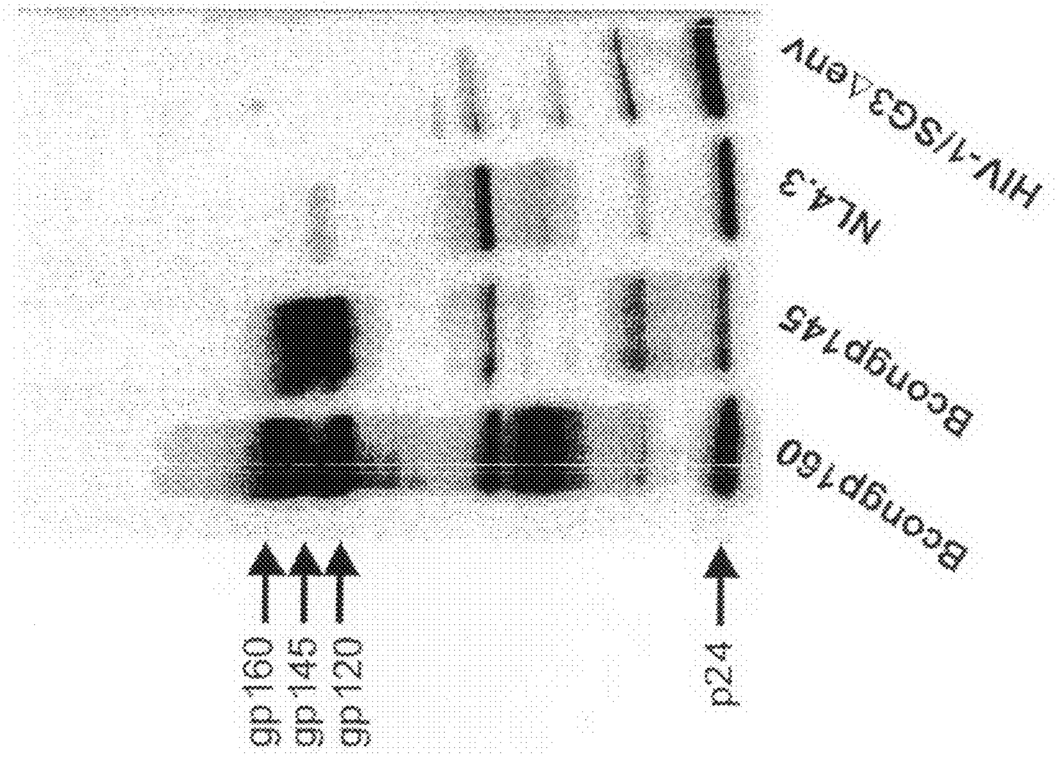
FIGS. 23A and 23B. Trans complementation of env-deficient HIV-1 with codon-optimized subtype B consensus gp160 and gp140 genes. Plasmids containing codon-optimized, subtype B consensus gp160 or gp140 genes were co-transfected into 293T cells with an HIV-1/SG3Δenv provirus. 48-hours post-transfection cell supernatants containing pseudotyped virus were harvested, clarified in a tabletop centrifuge, filtered through a 0.2 μM filter, and pellet through a 20% sucrose cushion. Quantification of p24 in each virus pellet was determined using the Coulter HIV-1 p24 antigen assay; 25 ng of p24 was loaded per lane on a 4-20% SDS-PAGE gel. Proteins were transferred to a PVDF membrane and probed with anti-HIV-1 antibodies from infected HIV-1 subtype B patient serum. Trans complementation with a rev-dependent NL4.3 env was included for control.
Figure 23B:
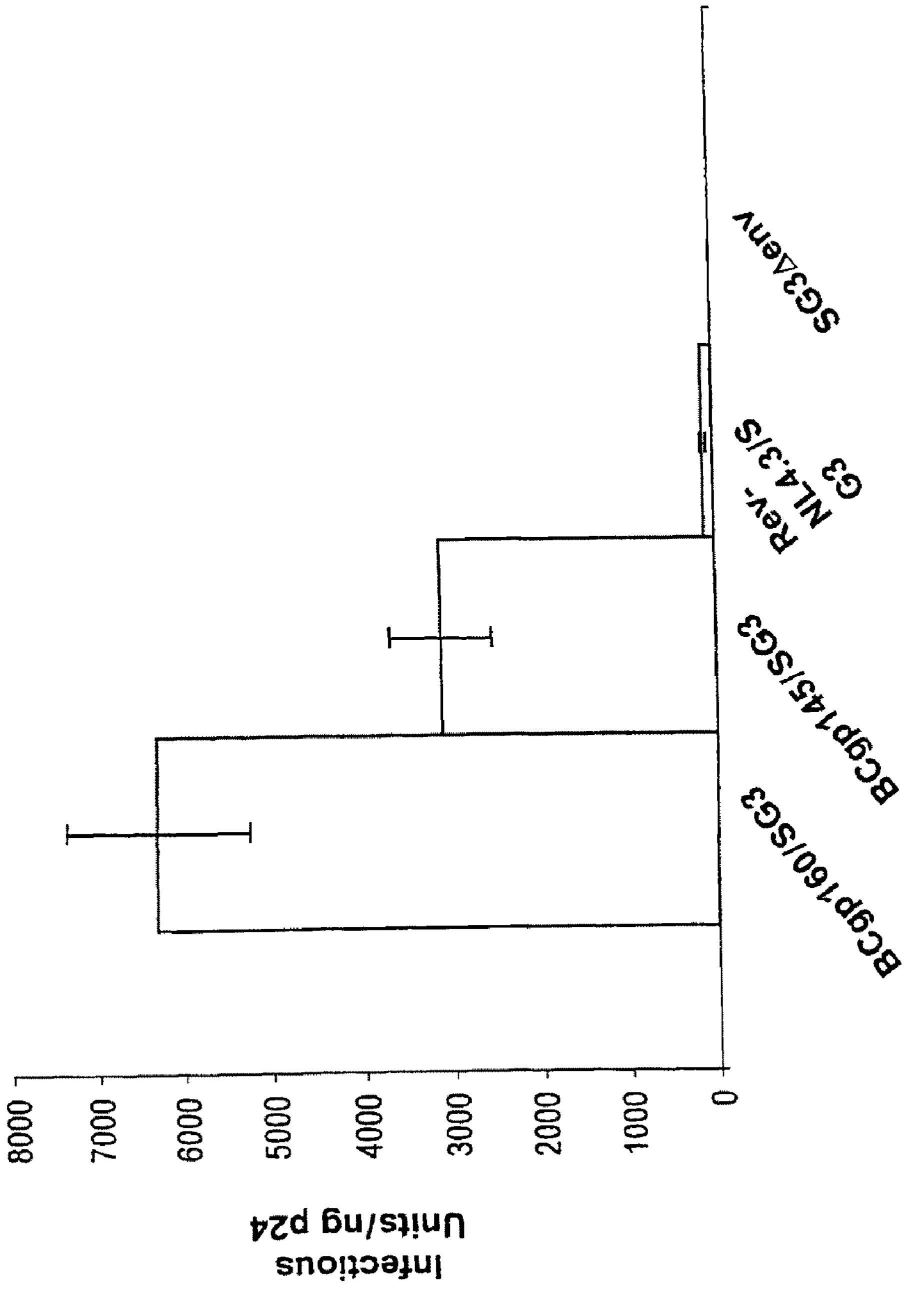

Western Blot analysis of sucrose-purified pseudovirions suggests at least five-fold higher levels of consensus B envelope incorporation compared to incorporation of a rev-dependent contemporary envelope (FIG. 23A). Virions pseudotyped with either the subtype B consensus gp160 or gp145 envelope are more infectious than pseudovirions containing a rev-dependent contemporary envelope (FIG. 23B).

Figure 22:
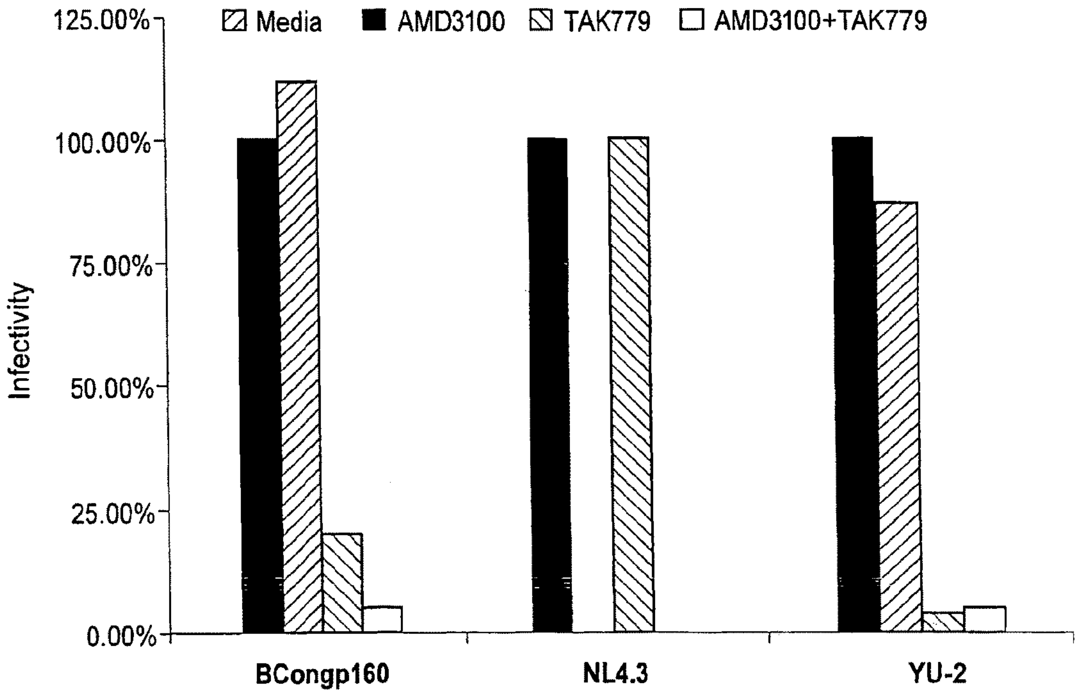
FIG. 22. Co-receptor usage of subtype B consensus envelopes. Pseudotyped particles containing the subtype B consensus gp160 Env were incubated with DEAE-Dextran treated JC53-BL cells in the presence of AMD3100 (a specific inhibitor of CXCR4), TAK779 (a specific inhibitor of CCR5), and AMD3000+TAK779 to determine co-receptor usage. NL4.3, an isolate known to utilize CXCR4 and YU-2, a known CCR5-using isolate, were included as controls.

Subtype B consensus envelopes utilize CCR5 as the co-receptor to gain entry into CD4 bearing target cells (FIG. 22).

Figure 24B:
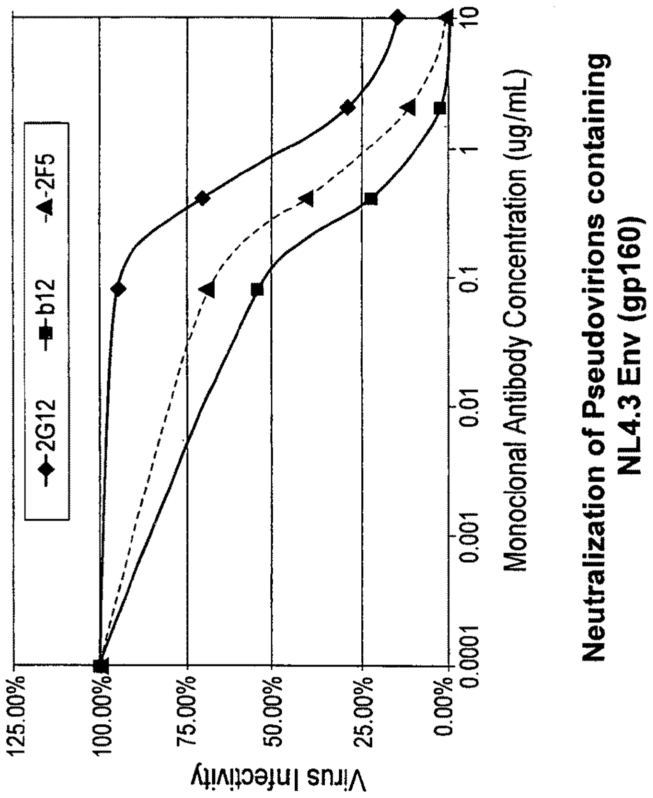
FIGS. 24A-24D. Neutralization sensitivity of virions containing subtype B consensus gp160 envelope. Equivalent amounts of pseudovirions containing the subtype B consensus or NL4.3 Env (gp160) (1,500 infectious units) were preincubated with three different monoclonal neutralizing antibodies and a panel of plasma samples from HIV-1 subtype B infected individuals, and then added to the JC53-BL cell monolayer in 96-well plates. Plates were cultured for two days and luciferase activity was measured as an indicator of viral infectivity. Virus infectivity was calculated by dividing the luciferase units (LU) produced at each concentration of antibody by the LU produced by the control infection. The mean 50% inhibitory concentration ($IC_{50}$) and the actual % neutralization at each antibody dilution were then calculated for each virus. The results of all luciferase experiments were confirmed by direct counting of blue foci in parallel infections.
Figure 24A:
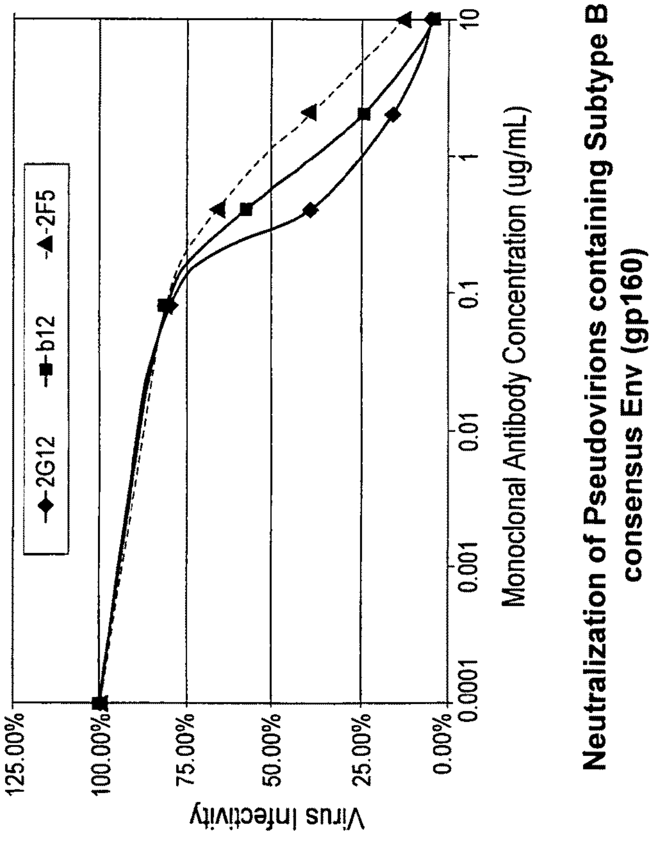
Figure 24C:
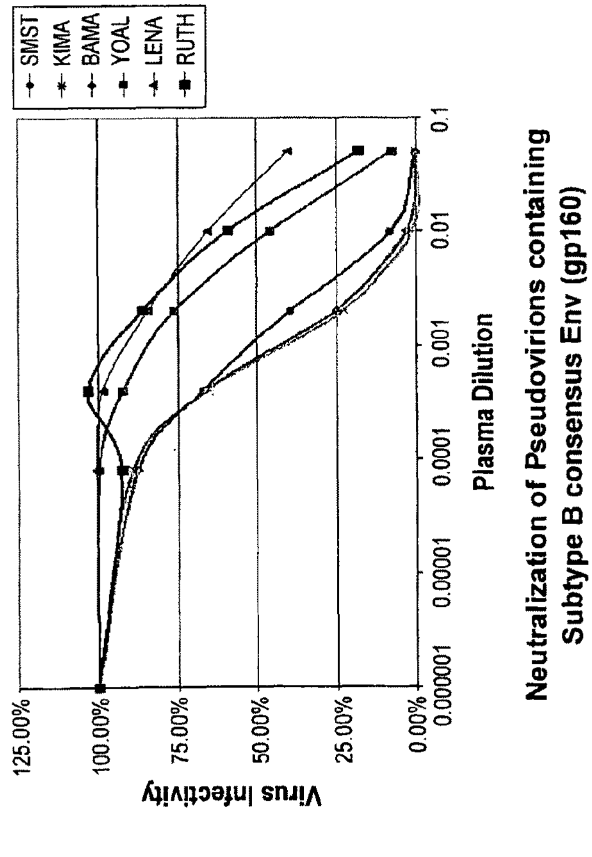
Figure 24D:
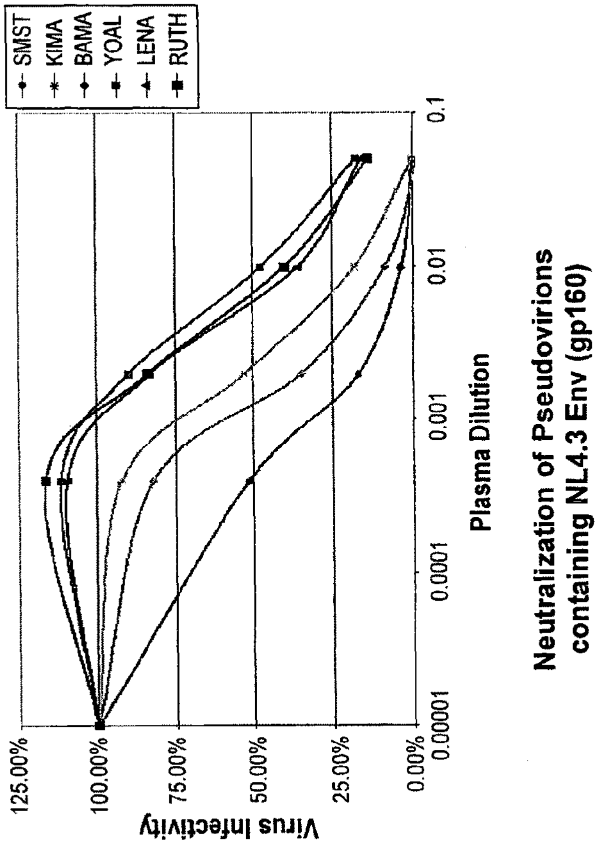

The infectivity of pseudovirions containing the subtype B consensus gp160 envelope was neutralized by plasma from HIV-1 subtype B infected patients (FIG. 24C) and neutralizing monoclonal antibodies (FIG. 24A). This suggests that the subtype B synthetic consensus B envelopes is similar to native HIV-1 Env glycoproteins in its overall structure and that common neutralization epitopes remain intact. FIGS. 24B and 24D show neutralization profiles of a subtype B control envelope (NL4.3 Env).

Figure 25A:
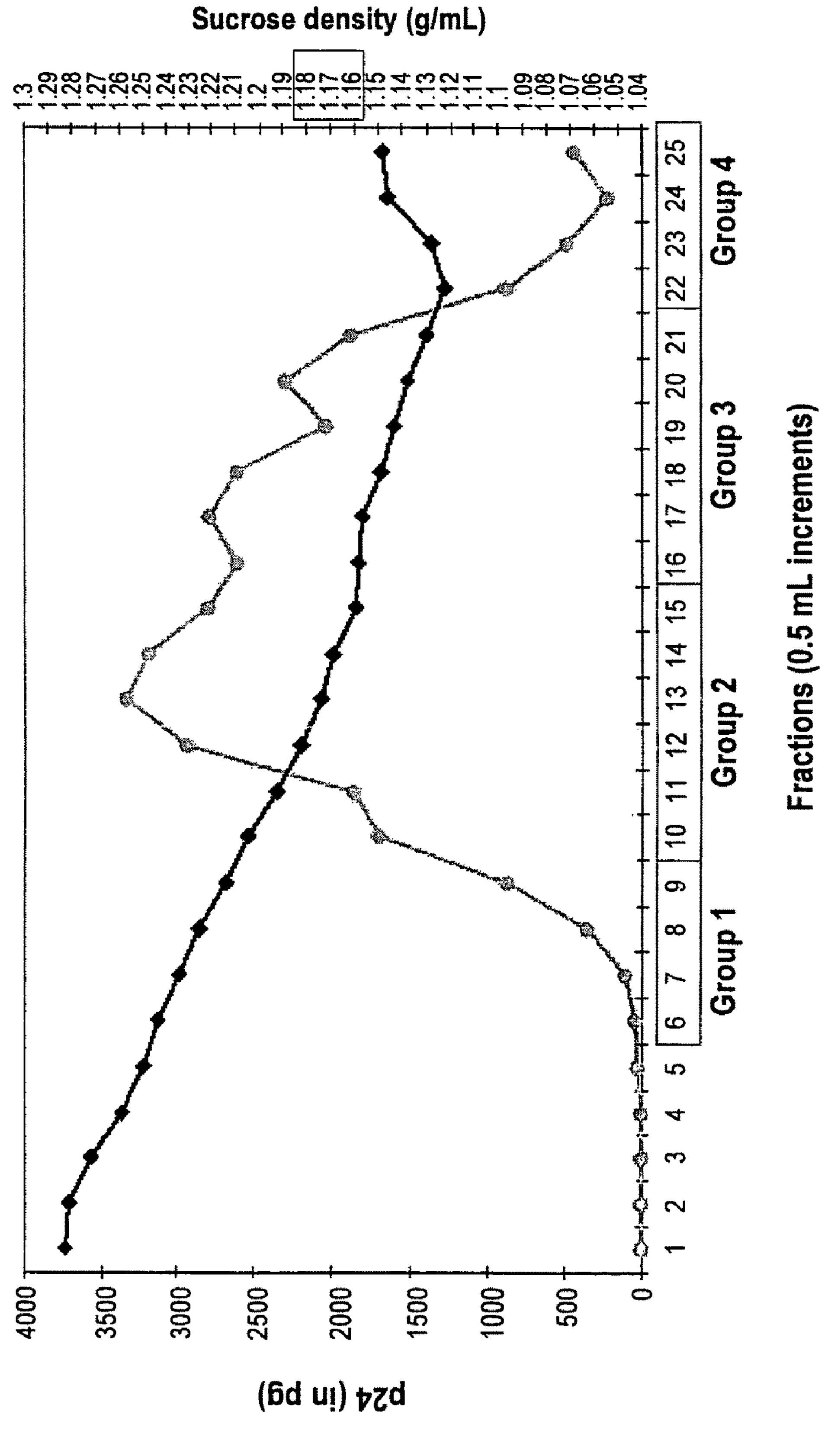
FIGS. 25A and 25B.
Figure 25B:
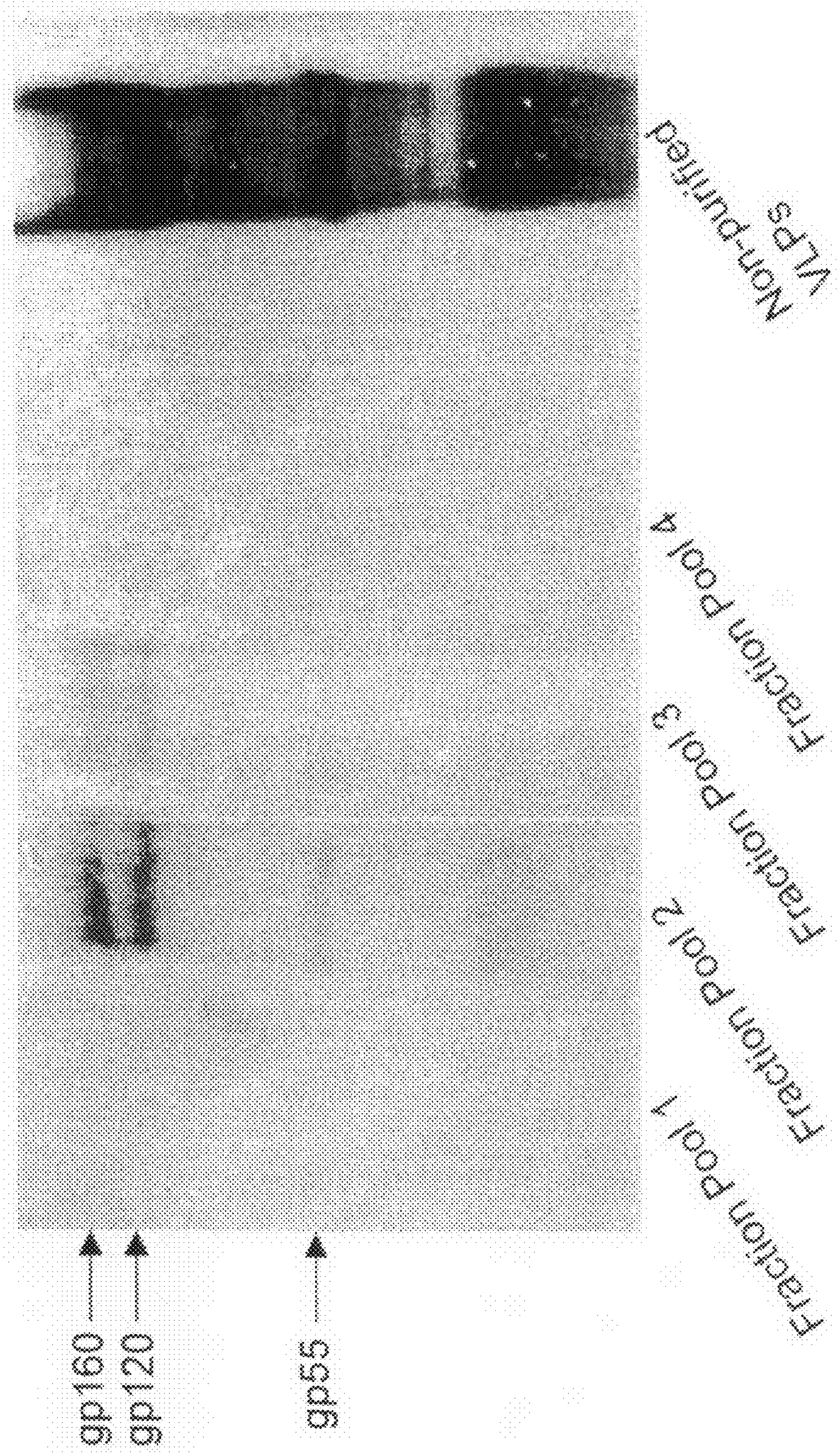

Subtype B consensus Gag proteins are able to bud from the cell membrane and form virus-like particles (FIG. 25A). Co-transfection of the codon-optimized subtype B consensus gag and gp160 genes produces VLPs with incorporated envelope (FIG. 25B).

Conclusions

The synthetic subtype B consensus env and gag genes express viral proteins that are similar in their structure, function and antigenicity to contemporary subtype B Env and Gag proteins. It is contemplated that immunogens based on subtype B consensus genes will elicit CTL and neutralizing immune responses that are protective against a broad set of HIV-1 isolates.

EXAMPLE 8

It will be appreciated from a review of FIG. 128 that the results obtained using subtype A, C and G consensus Envs are comparable to those obtained with CONS (e.g., see pseudovirus neut. assay results). The acute transmitted Env Clade C DU123 is a particularly good inducer of neutralizing antibodies.

In addition to the above, it will be appreciated that the results obtained using the JRFL mutant (CD4 binding site mutant) are superior to those obtained with WT JRFL and comparable to those obtained with CONS.

All documents and other information sources cited above are hereby incorporated in their entirety by reference. Also incorporated by reference is Liao et al, J. Virol. 78:5270 (2004)).

---

SEQUENCE LISTING (322 sequences)

SEQ ID NO: 1 - protein, 866 aa, Human immunodeficiency virus
MRVMGIQRNCQHLWRWGTMILGMLMICSAAENLWVTVYYGVPVWKEANTTLFCASDAKAYDTEVHNVWATHACVPTDPNPQEIVLENVTENFNMWKNNMVEQMHEDIISLWDQSLKPCVKLTPLCVTLNCTNVRNVSSNGTETDNEEIKNCSFNITTELRDKKQKVYALFYRLDVVPIDDKNSSEISGKNSSEYYRLINCNTSAITQACPKVSFEPIPIHYCAPAGFAILKCNDKKFNGTGPCKNVSTVQCTHGIKPVVSTQLLLNGSLAEEEIIIRSENITNNAKTIIVQLNESVEINCTRPNNNTRKSIHIGPGQAFYATGEIIGDIRQAHCNISRTKWNKTLQQVAKKLREHFNNKTIIFKPSSGGDLEITTHSFNCGGEFFYCNTSGLFNSTWMFNGTYMFNGTKDNSETITLPCRIKQIINMWQGVGQAMYAPPIEGKITCKSNITGLLLITRDGGNNSNKNKTETFRPGGGDMRDNWRSELYKYKVVKIEPLGVAPTKAKRRVVEREKRAVGIGAVFLGFLGAAGSTMGAASITLTVQARQLLSGIVQQQSNLLRAIEAQQHLLQLTVWGIKQLQARVLAVERYLKDQQLLGIWGCSGKLICTTNVPWNSSWSNKSQDEIWDNMTWMEWEREISNYTDIIYRLIEESQNQQEKNEQELLALDKASLWNWFDITNWLWYIKIFIMIVGGLIGLRIVFAVLSIVNRVRQGYSPLSFQTLIPNPRGPDRPEGIEEEGGEQGRDRSIRLVNGFLALAWDDLRSLCLFSYHRLRDFILIAARTVELLGRRSLRGLQKGWEALKYLGNLLQYWGQELKNSAISLLDTTAIAVAEGTDRVIEIVQRACRAILNIPRRIRQGLERALL

SEQ ID NO: 2 - DNA, 2607 bp, Human immunodeficiency virus
gccaccatgcgcgtgatgggcatccagcgcaactgccagcacctgtggcgctggggcaccatgatcctgggcatgctgatgatctgctccgccgccgagaacctgtgggtgaccgtgtactacggcgtgcccgtgtggaaggaggccaacaccaccctgttctgcgcctccgacgccaaggcctacgacaccgaggtgcacaacgtgtgggccacccacgcctgcgtgcccaccgaccccaacccccaggagatcgtgctggagaacgtgaccgagaacttcaacatgtggaagaacaacatggtggagcagatgcacgaggacatcatctccctgtgggaccagtccctgaagccctgcgtgaagctgacccccctgtgcgtgaccctgaactgcaccaacgtgcgcaacgtgtcctccaacggcaccgagaccgacaacgaggagatcaagaactgctccttcaacatcaccaccgagctgcgcgacaagaagcagaaggtgtacgccctgttctaccgcctggacgtggtgcccatcgacgacaagaactcctccgagatctccggcaagaactcctccgagtactaccgcctgatcaactgcaacacctccgccatcacccaggcctgccccaaggtgtccttcgagcccatccccatccactactgcgcccccgccggcttcgccatcctgaagtgcaacgacaagaagttcaacggcaccggcccctgcaagaacgtgtccaccgtgcagtgcacccacggcatcaagcccgtggtgtccacccagctgctgctgaacggctccctggccgaggaggagatcatcatccgctccgagaacatcaccaacaacgccaagaccatcatcgtgcagctgaacgagtccgtggagatcaactgcacccgccccaacaacaacacccgcaagtccatccacatcggccccggccaggccttctacgccaccggcgagatcatcggcgacatccgccaggcccactgcaacatctcccgcaccaagtggaacaagaccctgcagcaggtggccaagaagctgcgcgagcacttcaacaacaagaccatcatcttcaagccctcctccggcggcgacctggagatcaccacccactccttcaactgcggcggcgagttcttctactgcaacacctccggcctgttcaactccacctggatgttcaacggcacctacatgttcaacggcaccaaggacaactccgagaccatcaccctgccctgccgcatcaagcagatcatcaacatgtggcagggcgtgggccaggccatgtacgccccccccatcgagggcaagatcacctgcaagtccaacatcaccggcctgctgctgacccgcgacggcggcaacaactccaacaagaacaagaccgagaccttccgccccggcggcggcgacatgcgcgacaactggcgctccgagctgtacaagtacaaggtggtgaagatcgagcccctgggcgtggcccccaccaaggccaagcgccgcgtggtggagcgcgagaagcgcgccgtgggcatcggcgccgtgttcctgggcttcctgggcgccgccggctccaccatgggcgccgcctccatcaccctgaccgtgcaggcccgccagctgctgtccggcatcgtgcagcagcagtccaacctgctgcgcgccatcgaggcccagcagcacctgctgcagctgaccgtgtggggcatcaagcagctgcaggcccgcgtgctggccgtggagcgctacctgaaggaccagcagctgctgggcatctggggctgctccggcaagctgatctgcaccaccaacgtgccctggaactcctcctggtccaacaagtcccaggacgagatctgggacaacatgacctggatggagtgggagcgcgagatctccaactacaccgacatcatctaccgcctgatcgaggagtcccagaaccagcaggagaagaacgagcaggagctgctggccctggacaagtgggcctccctgtggaactggttcgacatcaccaactggctgtggtacatcaagatcttcatcatgatcgtgggcggcctgatcggcctgcgcatcgtgttcgccgtgctgtccatcgtgaaccgcgtgcgccagggctactcccccctgtccttccagaccctgatccccaacccccgcggccccgaccgccccgagggcatcgaggaggagggcggcgagcagggccgcgaccgctccatccgcctggtgaacggcttcctggccctggcctgggacgacctgcgctccctgtgcctgttctcctaccaccgcctgcgcgacttcatcctgatcgccgcccgcaccgtggagctgctgggccgccgctccctgcgcggcctgcagaagggctgggaggccctgaagtacctgggcaacctgctgcagtactggggccaggagctgaagaactccgccatctccctgctggacaccaccgccatcgccgtggccgagggcaccgaccgcgtgatcgagatcgtgcagcgcgcctgccgcgccatcctgaacatcccccgccgcatccgccagggcctggagcgcgccctgctgtaa

SEQ ID NO: 3 - DNA, 2535 bp, Human immunodeficiency virus
gccgccatgcgcgtgatgggcatcctgcgcaactgccagcagtggtggatctggggcatcctgggcttctggatgctgatgatctgctccgtggtgggcaacctgtgggtgaccgtgtactacggcgtgcccgtgtggaaggaggccaagaccaccctgttctgcgcctccgacgccaaggcctacgagcgcgaggtgcacaacgtgtgggccacccacgcctgcgtgcccaccgaccccaacccccaggagatggtgctggagaacgtgaccgagaacttcaacatgtggaagaacgacatggtggaccagatgcacgaggacatcatctccctgtgggaccagtccctgaagccctgcgtgaagctgacccccctgtgcgtgaccctgaactgcaccaacgtgaccaacgccaccaacaacacctacaacggcgagatgaagaactgctccttcaacatcaccaccgagctgcgcgacaagaagaagaaggagtacgccctgttctaccgcctggacatcgtgcccctgaacgagaactcctccgagtaccgcctgatcaactgcaacacctccgccatcacccaggcctgccccaaggtgtccttcgaccccatccccatccactactgcgcccccgccggctacgccatcctgaagtgcaacaacaagaccttcaacggcaccggcccctgcaacaacgtgtccaccgtgcagtgcacccacggcatcaagcccgtggtgtccacccagctgctgctgaacggctccctggccgaggaggagatcatcatccgctccgagaacctgaccgacaacgccaagaccatcatcgtgcagctgaacgagtccgtggagatcgtgtgcacccgccccaacaacaacacccgcaagtccatgcgcatcggccccggccagaccttctacgccaccggcgacatcatcggcgacatccgccaggcccactgcaacatctccgaggacaagtggaacaagaccctgcagcaggtggccgagaagctgggcaagcacttccccaacaagaccatcaccttcgagccctcctccggcggcgacctggagatcaccacccactccttcaactgccgcggcgagttcttctactgcaacacctccaagctgttcaactccacctacaacaacaacaccaactccaactccaccatcaccctgccctgccgcatcaagcagatcatcaacatgtggcagggcgtgggccaggccatgtacgccccccccatcgccggcaacatcacctgcaagtccaacatcaccggcctgctgctgacccgcgacggcggcaaggagaacaccaccgagaccttccgccccggcggcggcgacatgcgcgacaactggcgctccgagctgtacaagtacaaggtggtggagatcaagcccctgggcgtggcccccaccgaggccaagcgccgcgtggtggagcgcgagaagcgcgccgtgggcctgggcgccgtgttcctgggcttcctgggcgccgccggctccaccatgggcgccgcctccatcaccctgaccgtgcaggcccgccagctgctgtccggcatcgtgcagcagcagtccaacctgctgcgcgccatcgaggcccagcagcacatgctgcagctgaccgtgtggggcatcaagcagctgcaggcccgcgtgctggccatggagcgctacctgaaggaccagcagctgctgggcatctggggctgctccggcaagctgatctgcaccaccgccgtgccctggaactcctcctggtccaacaagtccctggacgacatctgggacaacatgacctggatggagtgggaccgcgagatctccaactacaccgacaccatctaccgcctgctggaggagtcccagaaccagcaggagaagaacgagcaggacctgctggccctggactcctgggagaacctgtggaactggttcgacatcaccaactggctgtggtacatcaagatcttcatcatgatcgtgggcggcctgatcggcctgcgcatcatcttcgccgtgctgtccatcgtgaaccgcgtgcgccagggctactcccccctgtccttccagaccctgacccccaacccccgcggccccgaccgcctggagcgcatcgaggaggagggcggcgagcaggaccgcgaccgctccatccgcctggtgtccggcttcctggccctggcctgggacgacctgcgctccctgtgcctgttctcctaccaccgcctgcgcgacttcatcctgatcgccgcccgcaccgtggagctgctgggccgctcctccctgcgcggcctgcagcgcggctgggaggccctgaagtacctgggctccctggtgcagtactggggccaggagctgaagaagtccgccatctccctgctggacaccatcgccatcgccgtggccgagggcaccgaccgcatcatcgaggtggtgcagcgcgcctgccgcgccatcctgaacatcccccgccgcatccgccagggcttcgaggccgccctgctgtaa

SEQ ID NO: 4 - DNA, 2535 bp, Human immunodeficiency virus
gccgccatgcgcgtgatgggcatcctgcgcaactgccagcagtggtggatctggggcatcctgggcttctggatgctgatgatctgcaacgtggtgggcaacctgtgggtgaccgtgtactacggcgtgcccgtgtggaaggaggccaagaccaccctgttctgcgcctccgacgccaaggcctacgagaaggaggtgcacaacgtgtgggccacccacgcctgcgtgcccaccgaccccaacccccaggagatggtgctggagaacgtgaccgagaacttcaacatgtggaagaacgacatggtggaccagatgcacgaggacatcatctccctgtgggaccagtccctgaagccctgcgtgaagctgacccccctgtgcgtgaccctgaactgccgcaacgtgaccaacgccaccaacaacacctacaacgaggagatcaagaactgctccttcaacatcaccaccgagctgcgcgacaagaagaagaaggtgtacgccctgttctaccgcctggacatcgtgcccctgaacgagaactcctccgagtaccgcctgatcaactgcaacacctccgccatcacccaggcctgccccaaggtgtccttcgaccccatccccatccactactgcgcccccgccggctacgccatcctgaagtgcaacaacaagaccttcaacggcaccggcccctgcaacaacgtgtccaccgtgcagtgcacccacggcatcaagcccgtggtgtccacccagctgctgctgaacggctccctggccgaggaggagatcatcatccgctccgagaacctgaccaacaacgccaagaccatcatcgtgcacctgaacgagtccgtggagatcgtgtgcacccgccccaacaacaacacccgcaagtccatccgcatcggccccggccagaccttctacgccaccggcgacatcatcggcgacatccgccaggcccactgcaacatctccgaggacaagtggaacaagaccctgcagcgcgtgtccaagaagctgaaggagcacttccccaacaagaccatcaagttcgagccctcctccggcggcgacctggagatcaccacccactccttcaactgccgcggcgagttcttctactgcaacacctccaagctgttcaactccacctacaacaacaacaccaactccaactccaccatcaccctgccctgccgcatcaagcagatcatcaacatgtggcaggaggtgggccgcgccatgtacgccccccccatcgccggcaacatcacctgcaagtccaacatcaccggcctgctgctgacccgcgacggcggcaagaagaacaccaccgagatcttccgccccggcggcggcgacatgcgcgacaactggcgctccgagctgtacaagtacaaggtggtggagatcaagcccctgggcgtggcccccaccaaggccaagcgccgcgtggtggagcgcgagaagcgcgccgtgggcatcggcgccgtgttcctgggcttcctgggcgccgccggctccaccatgggcgccgcctccatcaccctgaccgtgcaggcccgccagctgctgtccggcatcgtgcagcagcagtccaacctgctgcgcgccatcgaggcccagcagcacatgctgcagctgaccgtgtggggcatcaagcagctgcagacccgcgtgctggccatcgagcgctacctgaaggaccagcagctgctgggcatctggggctgctccggcaagctgatctgcaccaccgccgtgccctggaactcctcctggtccaacaagtcccaggaggacatctgggacaacatgacctggatgcagtgggaccgcgagatctccaactacaccgacaccatctaccgcctgctggaggactcccagaaccagcaggagaagaacgagaaggacctgctggccctggactcctggaagaacctgtggaactggttcgacatcaccaactggctgtggtacatcaagatcttcatcatgatcgtgggcggcctgatcggcctgcgcatcatcttcgccgtgctgtccatcgtgaaccgcgtgcgccagggctactcccccctgtccttccagaccctgacccccaacccccgcggccccgaccgcctgggccgcatcgaggaggagggcggcgagcaggaccgcgaccgctccatccgcctggtgtccggcttcctggccctggcctgggacgacctgcgctccctgtgcctgttctcctaccaccgcctgcgcgacttcatcctggtggccgcccgcgccgtggagctgctgggccgctcctccctgcgcggcctgcagcgcggctgggaggccctgaagtacctgggctccctggtgcagtactggggcctggagctgaagaagtccgccatctccctgctggacaccatcgccatcgccgtggccgagggcaccgaccgcatcatcgagctgatccagcgcatctgccgcgccatccgcaacatcccccgccgcatccgccagggcttcgaggccgccctgcagtaa

SEQ ID NO: 5 - protein, 842 aa, Human immunodeficiency virus
MRVMGILRNCQQWWIWGILGFWMLMICSVVGNLWVTVYYGVPVWKEAKTTLFCASDAKAYEREVHNVWATHACVPTDPNPQEMVLENVTENFNMWKNDMVDQMHEDIISLWDQSLKPCVKLTPLCVTLNCTNVTNATNNTYNGEMKNCSFNITTELRDKKKKEYALFYRLDIVPLNENSSEYRLINCNTSAITQACPKVSFDPIPIHYCAPAGYAILKCNNKTFNGTGPCNNVSTVQCTHGIKPVVSTQLLLNGSLAEEEIIIRSENLTDNAKTIIVQLNESVEIVCTRPNNNTRKSMRIGPGQTFYATGDIIGDIRQAHCNISEDKWNKTLQQVAEKLGKHFPNKTITFEPSSGGDLEITTHSFNCRGEFFYCNTSKLFNSTYNNNTNSNSTITLPCRIKQIINMWQGVGQAMYAPPIAGNITCKSNITGLLLTRDGGKENTTETFRPGGGDMRDNWRSELYKYKVVEIKPLGVAPTEAKRRVVEREKRAVGLGAVFLGFLGAAGSTMGAASITLTVQARQLLSGIVQQQSNLLRAIEAQQHMLQLTVWGIKQLQARVLAMERYLKDQQLLGIWGCSGKLICTTAVPWNSSWSNKSLDDIWDNMTWMEWDREISNYTDTIYRLLEESQNQQEKNEQDLLALDSWENLWNWFDITNWLWYIKIFIMIVGGLIGLRIIFAVLSIVNRVRQGYSPLSFQTLTPNPRGPDRLERIEEEGGEQDRDRSIRLVSGFLALAWDDLRSLCLFSYHRLRDFILIAARTVELLGRSSLRGLQRGWEALKYLGSLVQYWGQELKKSAISLLDTIAIAVAEGTDRIIEVVQRACRAILNIPRRIRQGFEAALL

SEQ ID NO: 6 - protein, 842 aa, Human immunodeficiency virus
MRVMGILRNCQQWWIWGILGFWMLMICNVVGNLWVTVYYGVPVWKEAKTTLFCASDAKAYEKEVHNVWATHACVPTDPNPQEMVLENVTENFNMWKNDMVDQMHEDIISLWDQSLKPCVKLTPLCVTLNCRNVTNATNNTYNEEIKNCSFNITTELRDKKKKVYALFYRLDIVPLNENSSEYRLINCNTSAITQACPKVSFDPIPIHYCAPAGYAILKCNNKTFNGTGPCNNVSTVQCTHGIKPVVSTQLLLNGSLAEEEIIIRSENLTNNAKTIIVHLNESVEIVCTRPNNNTRKSIRIGPGQTFYATGDIIGDIRQAHCNISEDKWNKTLQRVSKKLKEHFPNKTIKFEPSSGGDLEITTHSFNCRGEFFYCNTSKLFNSTYNNNTNSNSTITLPCRIKQIINMWQEVGRAMYAPPIAGNITCKSNITGLLLTRDGGKKNTTEIFRPGGGDMRDNWRSELYKYKVVEIKPLGVAPTKAKRRVVEREKRAVGIGAVFLGFLGAAGSTMGAASITLTVQARQLLSGIVQQQSNLLRAIEAQQHMLQLTVWGIKQLQTRVLAIERYLKDQQLLGIWGCSGKLICTTAVPWNSSWSNKSQEDIWDNMTWMQWDREISNYTDTIYRLLEDSQNQQEKNEKDLLALDSWKNLWNWFDITNWLWYIKIFIMIVGGLIGLRIIFAVLSIVNRVRQGYSPLSFQTLTPNPRGPDRLGRIEEEGGEQDRDRSIRLVSGFLALAWDDLRSLCLFSYHRLRDFILVAARAVELLGRSSLRGLQRGWEALKYLGSLVQYWGLELKKSAISLLDTIAIAVAEGTDRIIELIQRICRAIRNIPRRIRQGFEAALQ

SEQ ID NO: 7 - protein, 842 aa, Human immunodeficiency virus
MRVMGILRNCQQWWIWGILGFWMLMICNVVGNLWVTVYYGVPVWKEAKTTLFCASDAKAYEKEVHNVWATHACVPTDPNPQEMVLENVTENFNMWKNDMVDQMHEDIISLWDQSLKPCVKLTPLCVTLNCRNVTNATNNTYNEEIKNCSFNITTELRDKKKKVYALFYRLDIVPLNENSSEYRLINCNTSAITQACPKVSFDPIPIHYCAPAGYAILKCNNKTFNGTGPCNNVSTVQCTHGIKPVVSTQLLLNGSLAEEEIIIRSENLTNNAKTIIVHLNESVEIVCTRPNNNTRKSIRIGPGQTFYATGDIIGDIRQAHCNISEDKWNKTLQRVSKKLKEHFPNKTIKFEPSSGGDLEITTHSFNCRGEFFYCNTSKLFNSTYNNNTNSNSTITLPCRIKQIINMWQEVGRAMYAPPIAGNITCKSNITGLLLTRDGGKKNTTEIFRPGGGDMRDNWRSELYKYKVVEIKPLGVAPTKAKRRVVEREKRAVGIGAVFLGFLGAAGSTMGAASITLTVQARQLLSGIVQQQSNLLRAIEAQQHMLQLTVWGIKQLQTRVLAIERYLKDQQLLGIWGCSGKLICTTAVPWNSSWSNKSQEDIWDNMTWMQWDREISNYTDTIYRLLEDSQNQQEKNEKDLLALDSWKNLWNWFDITNWLWYIKIFIMIVGGLIGLRIIFAVLSIVNRVRQGYSPLSFQTLTPNTRGPDRLGRIEEEGGEQDRDRSIRLVSGFLALAWDDLRSLCLFSYHRLRDFILVAARAVELLGRSSLRGLQRGWEALKYLGSLVQYWGLELKKSAISLLDTIAIAVAEGTDRIIELIQRICRAIRNIPRRIRQGFEAALQ

SEQ ID NO: 8 - protein, 842 aa, Human immunodeficiency virus
MRVMGILRNCQQWWIWGILGFWMLMICSVVGNLWVTVYYGVPVWKEAKTTLFCASDAKAYEREVHNVWATHACVPTDPNPQEMVLENVTENFNMWKNDMVDQMHEDIISLWDQSLKPCVKLTPLCVTLNCTNVTNATNNTYNGEMKNCSFNITTELRDKKKKEYALFYRLDIVPLNENSSEYRLINCNTSAITQACPKVSFDPIPIHYCAPAGYAILKCNNKTFNGTGPCNNVSTVQCTHGIKPVVSTQLLLNGSLAEEEIIIRSENLTDNAKTIIVQLNESVEIVCTRPNNNTRKSMRIGPGQTFYATGDIIGDIRQAHCNISEDKWNKTLQQVAEKLGKHFPNKTITFEPSSGGDLEITTHSFNCRGEFFYCNTSKLFNSTYNNNTNSNSTITLPCRIKQIINMWQGVGQAMYAPPIAGNITCKSNITGLLLTRDGGKENTTETFRPGGGDMRDNWRSELYKYKVVEIKPLGVAPTEAKRRVVEREKRAVGLGAVFLGFLGAAGSTMGAASITLTVQARQLLSGIVQQQSNLLRAIEAQQHMLQLTVWGIKQLQARVLAMERYLKDQQLLGIWGCSGKLICTTAVPWNSSWSNKSLEDIWDNMTWMEWDREISNYTDTIYRLLEESQNQQEKNEQDLLALDSWENLWNWFDITNWLWYIKIFIMIVGGLIGLRIIFAVLSIVNRVRQGYSPLSFQTLTPNTRGPDRLERIEEEGGEQDRDRSIRLVSGFLALAWDDLRSLCLFSYHRLRDFILIAARTVELLGRSSLRGLQRGWEALKYLGSLVQYWGQELKKSAISLLDTIAIAVAEGTDRIIEVVQRACRAILNIPRRIRQGFEAALL

SEQ ID NO: 9 - protein, 493 aa, Human immunodeficiency virus
MGARASILRGGKLDTWEKIRLRPGGKKRYMIKHLVWASRELERFALNPGLLETSEGCKQIMKQLQPALQTGTEELRSLYNTVATLYCVHEKIEVRDTKEALDKIEEEQNKSQQKTQQAEAAADGKVSQNYPIVQNLQGQMVHQAISPRTLNAWVKVIEEKAFSPEVIPMFTALSEGATPQDLNTMLNTVGGHQAAMQMLKDTINEEAAEWDRLHPVHAGPIAPGQMREPRGSDIAGTTSTLQEQIAWMTSNPPVPVGDIYKRWIILGLNKIVRMYSPVSILDIKQGPKEPFRDYVDRFFKTLRAEQATQDVKNWMTDTLLVQNANPDCKTILRALGPGASLEEMMTACQGVGGPSHKARVLAEAMSQANNTNIMMQRSNFKGPKRIVKCFNCGKEGHIARNCRAPRKKGCWKCGKEGHQMKDCTERQANFLGKIWPSHKGRPGNFLQSRPEPTAPPAESFRFEETTPAPKQEPKDREPLTSLKSLFGSDPLSQ

SEQ ID NO: 10 - protein, 207 aa, Human immunodeficiency virus
MGGKWSKSSIVGWPAVRERIRRTEPAAEGVGAASQDLDKYGALTSSNTATNNADCAWLEAQEEEEEVGFPVRPQVPLRPMTYKAAFDLSFFLKEKGGLEGLIYSKKRQEILDLWVYHTQGFFPDWQNYTPGPGVRYPLTFGWCFKLVPVDPREVEEANEGENNCLLHPMSQHGMEDEDREVLKWKFDSHLARRHMARELHPEYYKDC

SEQ ID NO: 11 - DNA, 1491 bp, Human immunodeficiency virus
gccgccgccatgggcgcccgcgccagcatcctgcgcggcggcaagctggacacctgggagaagatccgcctgcgccccggcggcaagaagcgctacatgatcaagcacctggtgtgggccagccgcgagctggagcgcttcgccctgaaccccggcctgctggagaccagcgagggctgcaagcagatcatgaagcagctgcagcccgccctgcagaccggcaccgaggagctgcgcagcctgtacaacaccgtggccaccctgtactgcgtgcacgagaagatcgaggtgcgcgacaccaaggaggccctggacaagatcgaggaggagcagaacaagagccagcagaagacccagcaggccgaggccgccgccgacggcaaggtgagccagaactaccccatcgtgcagaacctgcagggccagatggtgcaccaggccatcagcccccgcaccctgaacgcctgggtgaaggtgatcgaggagaaggccttcagccccgaggtgatccccatgttcaccgccctgagcgagggcgccaccccccaggacctgaacaccatgctgaacaccgtgggcggccaccaggccgccatgcagatgctgaaggacaccatcaacgaggaggccgccgagtgggaccgcctgcaccccgtgcacgccggccccatcgcccccggccagatgcgcgagccccgcggcagcgacatcgccggcaccaccagcaccctgcaggagcagatcgcctggatgaccagcaacccccccgtgcccgtgggcgacatctacaagcgctggatcatcctgggcctgaacaagatcgtgcgcatgtacagccccgtgagcatcctggacatcaagcagggccccaaggagcccttccgcgactacgtggaccgcttcttcaagaccctgcgcgccgagcaggccacccaggacgtgaagaactggatgaccgacaccctgctggtgcagaacgccaaccccgactgcaagaccatcctgcgcgccctgggccccggcgccagcctggaggagatgatgaccgcctgccagggcgtgggcggccccagccacaaggcccgcgtgctggccgaggccatgagccaggccaacaacaccaacatcatgatgcagcgcagcaacttcaagggccccaagcgcatcgtgaagtgcttcaactgcggcaaggagggccacatcgcccgcaactgccgcgccccccgcaagaagggctgctggaagtgcggcaaggagggccaccagatgaaggactgcaccgagcgccaggccaacttcctgggcaagatctggcccagccacaagggccgccccggcaacttcctgcagagccgccccgagcccaccgccccccccgccgagagcttccgcttcgaggagaccacccccgcccccaagcaggagcccaaggaccgcgagcccctgaccagcctgaagagcctgttcggcagcgaccccctgagccagtaa

SEQ ID NO: 12 - DNA, 633 bp, Human immunodeficiency virus
gccgccgccatgggcggcaagtggagcaagagcagcatcgtgggctggcccgccgtgcgcgagcgcatccgccgcaccgagcccgccgccgagggcgtgggcgccgccagccaggacctggacaagtacggcgccctgaccagcagcaacaccgccaccaacaacgccgactgcgcctggctggaggcccaggaggaggaggaggaggtgggcttccccgtgcgcccccaggtgcccctgcgccccatgacctacaaggccgccttcgacctgagcttcttcctgaaggagaagggcggcctggagggcctgatctacagcaagaagcgccaggagatcctggacctgtgggtgtaccacacccagggcttcttccccgactggcagaactacacccccggccccggcgtgcgctaccccctgaccttcggctggtgcttcaagctggtgcccgtggacccccgcgaggtggaggaggccaacgagggcgagaacaactgcctgctgcaccccatgagccagcacggcatggaggacgaggaccgcgaggtgctgaagtggaagttcgacagccacctggcccgccgccacatggcccgcgagctgcaccccgagtactacaaggactgctga

SEQ ID NO: 13 - protein, 852 aa, Human immunodeficiency virus
MRVRGIQRNCQHLWRWGTLILGMLMICSAAENLWVTVYYGVPVWKEANTTLFCASDAKAYDTEVHNVWATHACVPTDPNPQEIVLENVTENFNMWKNNMVEQMHEDIISLWDQSLKPCVKLTPLCVTLNCTNVNVTNTTNNTEEKGEIKNCSFNITTEIRDKKQKVYALFYRLDVVPIDDNNNNSSNYRLINCNTSAITQACPKVSFEPIPIHYCAPAGFAILKCNDKKFNGTGPCKNVSTVQCTHGIKPVVSTQLLLNGSLAEEEIIIRSENITNNAKTIIVQLNESVEINCTRPNNNTRKSIRIGPGQAFYATGDIIGDIRQAHCNISGTKWNKTLQQVAKKLREHFNNKTIIFKPSSGGDLEITTHSFNCRGEFFYCNTSGLFNSTWIGNGTKNNNNTNDTITLPCRIKQIINMWQGVGQAMYAPPIEGKITCKSNITGLLLTRDGGNNNTNETEIFRPGGGDMRDNWRSELYKYKVVKIEPLGVAPTKAKRRVVEREKRAVGIGAVFLGFLGAAGSTMGAASITLTVQARQLLSGIVQQQSNLLRAIEAQQHLLQLTVWGIKQLQARVLAVERYLKDQQLLGIWGCSGKLICTTTVPWNSSWSNKSQDEIWDNMTWMEWEREINNYTDIIYSLIEESQNQQEKNEQELLALDKWASLWNWFDITNWLWYIKIFIMIVGGLIGLRIVFAVLSIVNRVRQGYSPLSFQTLIPNPRGPDRPEGIEEEGGEQDRDRSIRLVNGFLALAWDDLRSLCLFSYHRLRDFILIAARTVELLGRKGLRRGWEALKYLWNLLQYWGQELKNSAISLLDTTAIAVAEGTDRVIEVVQRACRAILNIPRRIRQGLERALL

SEQ ID NO: 14 - DNA, 2568 bp, Human immunodeficiency virus
gccgccgccatgcgcgtgcgcggcatccagcgcaactgccagcacctgtggcgctggggcaccctgatcctgggcatgctgatgatctgctccgccgccgagaacctgtgggtgaccgtgtactacggcgtgcccgtgtggaaggaggccaacaccaccctgttctgcgcctccgacgccaaggcctacgacaccgaggtgcacaacgtgtgggccacccacgcctgcgtgcccaccgaccccaacccccaggagatcgtgctggagaacgtgaccgagaacttcaacatgtggaagaacaacatggtggagcagatgcacgaggacatcatctccctgtgggaccagtccctgaagccctgcgtgaagctgacccccctgtgcgtgaccctgaactgcaccaacgtgaacgtgaccaacaccaccaacaacaccgaggagaagggcgagatcaagaactgctccttcaacatcaccaccgagatccgcgacaagaagcagaaggtgtacgccctgttctaccgcctggacgtggtgcccatcgacgacaacaacaacaactcctccaactaccgcctgatcaactgcaacacctccgccatcacccaggcctgccccaaggtgtccttcgagcccatccccatccactactgcgcccccgccggcttcgccatcctgaagtgcaacgacaagaagttcaacggcaccggcccctgcaagaacgtgtccaccgtgcagtgcacccacggcatcaagcccgtggtgtccacccagctgctgctgaacggctccctggccgaggaggagatcatcatccgctccgagaacatcaccaacaacgccaagaccatcatcgtgcagctgaacgagtccgtggagatcaactgcacccgccccaacaacaacacccgcaagtccatccgcatcggccccggccaggccttctacgccaccggcgacatcatcggcgacatccgccaggcccactgcaacatctccggcaccaagtggaacaagaccctgcagcaggtggccaagaagctgcgcgagcacttcaacaacaagaccatcatcttcaagccctcctccggcggcgacctggagatcaccacccactccttcaactgccgcggcgagttcttctactgcaacacctccggcctgttcaactccacctggatcggcaacggcaccaagaacaacaacaacaccaacgacaccatcaccctgccctgccgcatcaagcagatcatcaacatgtggcagggcgtgggccaggccatgtacgccccccccatcgagggcaagatcacctgcaagtccaacatcaccggcctgctgctgacccgcgacggcggcaacaacaacaccaacgagaccgagatcttccgccccggcggcggcgacatgcgcgacaactggcgctccgagctgtacaagtacaaggtggtgaagatcgagcccctgggcgtggcccccaccaaggccaagcgccgcgtggtggagcgcgagaagcgcgccgtgggcatcggcgccgtgttcctgggcttcctgggcgccgccggctccaccatgggcgccgcctccatcaccctgaccgtgcaggcccgccagctgctgtccggcatcgtgcagcagcagtccaacctgctgcgcgccatcgaggcccagcagcacctgctgcagctgaccgtgtggggcatcaagcagctgcaggcccgcgtgctggccgtggagcgctacctgaaggaccagcagctgctgggcatctggggctgctccggcaagctgatctgcaccaccaccgtgccctggaactcctcctggtccaacaagtcccaggacgagatctgggacaacatgacctggatggagtgggagcgcgagatcaacaactacaccgacatcatctactccctgatcgaggagtcccagaaccagcaggagaagaacgagcaggagctgctggccctggacaagtgggcctccctgtggaactggttcgacatcaccaactggctgtggtacatcaagatcttcatcatgatcgtgggcggcctgatcggcctgcgcatcgtgttcgccgtgctgtccatcgtgaaccgcgtgcgccagggctactcccccctgtccttccagaccctgatccccaacccccgcggccccgaccgccccgagggcatcgaggaggagggcggcgagcaggaccgcgaccgctccatccgcctggtgaacggcttcctggccctggcctgggacgacctgcgctccctgtgcctgttctcctaccaccgcctgcgcgacttcatcctgatcgccgcccgcaccgtggagctgctgggccgcaagggcctgcgccgcggctgggaggccctgaagtacctgtggaacctgctgcagtactggggccaggagctgaagaactccgccatctccctgctggacaccaccgccatcgccgtggccgagggcaccgaccgcgtgatcgaggtggtgcagcgcgcctgccgcgccatcctgaacatcccccgccgcatccgccagggcctggagcgcgccctgctgtaa

SEQ ID NO: 15 - protein, 857 aa, Human immunodeficiency virus
MRVMGIQRNCQHLWRWGTMILGMIIICSAAENLWVTVYYGVPVWKDAETTLFCASDAKAYDTEVHNVWATHACVPTDPNPQEINLENVTEEFNMWKNNMVEQMHTDIISLWDQSLKPCVKLTPLCVTLNCSNVNVTTNITNITDNMKGEIKNCSFNMTTELRDKKQKVYSLFYKLDVVQINKSNSSSQYRLINCNTSAITQACPKVSFEPIPIHYCAPAGFAILKCKDKEFNGTGPCKNVSTVQCTHGIKPVVSTQLLLNGSLAEEEVMIRSENITNNAKNIIVQLTKPVKINCTRPNNNTRKSIRIGPGQAFYATGDIIGDIRQAHCNVSRTEWNETLQKVAKQLRKYFNNKTIIFTNSSGGDLEITTHSFNCGGEFFYCNTSGLFNSTWNGNGTKKKNSTESNDTITLPCRIKQIINMWQRVGQAMYAPPIQGVIRCESNITGLLLTRDGGDNNSKNETFRPGGGDMRDNWRSELYKYKVVKIEPLGVAPTKAKRRVVEREKRAVGIGAVFLGFLGAAGSTMGAASITLTVQARQLLSGIVQQQSNLLRAIEAQQHLLKLTVWGIKQLQARVLAVERYLKDQQLLGIWGCSGKLICTTNVPWNSSWSNKSQSEIWDNMTWLQWDKEISNYTDIIYNLIEESQNQQEKNEQDLLALDKWANLWNWFDISNWLWYIKIFIMIVGGLIGLRIVFAVLSVINRVRQGYSPLSFQTHTPNPGGLDRPGRIEEEGGEQGRDRSIRLVSGFLALAWDDLRSLCLFSYHRLRDFILIAARTVELLGHSSLKGLRLGWEGLKYLWNLLLYWGRELKISAINLLDTIAIAVAGWTDRVIEIGQRICRAILNIPRRIRQGLERALL

SEQ ID NO: 16 - DNA, 2583 bp, Human immunodeficiency virus
gccgccgccatgcgcgtgatgggcatccagcgcaactgccagcacctgtggcgctggggcaccatgatcctgggcatgatcatcatctgctccgccgccgagaacctgtgggtgaccgtgtactacggcgtgcccgtgtggaaggacgccgagaccaccctgttctgcgcctccgacgccaaggcctacgacaccgaggtgcacaacgtgtgggccacccacgcctgcgtgcccaccgaccccaacccccaggagatcaacctggagaacgtgaccgaggagttcaacatgtggaagaacaacatggtggagcagatgcacaccgacatcatctccctgtgggaccagtccctgaagccctgcgtgaagctgacccccctgtgcgtgaccctgaactgctccaacgtgaacgtgaccaccaacatcaccaacatcaccgacaacatgaagggcgagatcaagaactgctccttcaacatgaccaccgagctgcgcgacaagaagcagaaggtgtactccctgttctacaagctggacgtggtgcagatcaacaagtccaactcctcctcccagtaccgcctgatcaactgcaacacctccgccatcacccaggcctgccccaaggtgtccttcgagcccatccccatccactactgcgcccccgccggcttcgccatcctgaagtgcaaggacaaggagttcaacggcaccggcccctgcaagaacgtgtccaccgtgcagtgcacccacggcatcaagcccgtggtgtccacccagctgctgctgaacggctccctggccgaggaggaggtgatgatccgctccgagaacatcaccaacaacgccaagaacatcatcgtgcagctgaccaagcccgtgaagatcaactgcacccgccccaacaacaacacccgcaagtccatccgcatcggccccggccaggccttctacgccaccggcgacatcatcggcgacatccgccaggcccactgcaacgtgtcccgcaccgagtggaacgagaccctgcagaaggtggccaagcagctgcgcaagtacttcaacaacaagaccatcatcttcaccaactcctccggcggcgacctggagatcaccacccactccttcaactgcggcggcgagttcttctactgcaacacctccggcctgttcaactccacctggaacggcaacggcaccaagaagaagaactccaccgagtccaacgacaccatcaccctgccctgccgcatcaagcagatcatcaacatgtggcagcgcgtgggccaggccatgtacgccccccccatccagggcgtgatccgctgcgagtccaacatcaccggcctgctgctgacccgcgacggcggcgacaacaactccaagaacgagaccttccgccccggcggcggcgacatgcgcgacaactggcgctccgagctgtacaagtacaaggtggtgaagatcgagcccctgggcgtggcccccaccaaggccaagcgccgcgtggtggagcgcgagaagcgcgccgtgggcatcggcgccgtgttcctgggcttcctgggcgccgccggctccaccatgggcgccgcctccatcaccctgaccgtgcaggcccgccagctgctgtccggcatcgtgcagcagcagtccaacctgctgcgcgccatcgaggcccagcagcacctgctgaagctgaccgtgtggggcatcaagcagctgcaggcccgcgtgctggccgtggagcgctacctgaaggaccagcagctgctgggcatctggggctgctccggcaagctgatctgcaccaccaacgtgccctggaactcctcctggtccaacaagtcccagtccgagatctgggacaacatgacctggctgcagtgggacaaggagatctccaactacaccgacatcatctacaacctgatcgaggagtcccagaaccagcaggagaagaacgagcaggacctgctggccctggacaagtgggccaacctgtggaactggttcgacatctccaactggctgtggtacatcaagatcttcatcatgatcgtgggcggcctgatcggcctgcgcatcgtgttcgccgtgctgtccgtgatcaaccgcgtgcgccagggctactcccccctgtccttccagacccacacccccaaccccggcggcctggaccgccccggccgcatcgaggaggagggcggcgagcagggccgcgaccgctccatccgcctggtgtccggcttcctggccctggcctgggacgacctgcgctccctgtgcctgttctcctaccaccgcctgcgcgacttcatcctgatcgccgcccgcaccgtggagctgctgggccactcctccctgaagggcctgcgcctgggctgggagggcctgaagtacctgtggaacctgctgctgtactggggccgcgagctgaagatctccgccatcaacctgctggacaccatcgccatcgccgtggccggctggaccgaccgcgtgatcgagatcggccagcgcatctgccgcgccatcctgaacatcccccgccgcatccgccagggcctggagcgcgccctgctgtaa

SEQ ID NO: 17 - DNA, 1503 bp, Human immunodeficiency virus
gccgccgccatgggcgcccgcgcctccgtgctgtccggcggcaagctggacgcctgggagaagatccgcctgcgccccggcggcaagaagaagtaccgcctgaagcacctggtgtgggcctcccgcgagctggagcgcttcgccctgaaccccggcctgctggagacctccgagggctgcaagcagatcatcggccagctgcagcccgccctgcagaccggctccgaggagctgcgctccctgtacaacaccgtggccaccctgtactgcgtgcaccagcgcatcgaggtgaaggacaccaaggaggccctggagaagatcgaggaggagcagaacaagtcccagcagaagacccagcaggccgccgccgacaagggcaactcctccaaggtgtcccagaactaccccatcgtgcagaacctgcagggccagatggtgcaccaggccatctccccccgcaccctgaacgcctgggtgaaggtgatcgaggagaaggccttctcccccgaggtgatccccatgttctccgccctgtccgagggcgccaccccccaggacctgaacaccatgctgaacaccgtgggcggccaccaggccgccatgcagatgctgaaggacaccatcaacgaggaggccgccgagtgggaccgcctgcaccccgtgcacgccggccccatcccccccggccagatgcgcgagccccgcggctccgacatcgccggcaccacctccaccctgcaggagcagatcgcctggatgacctccaacccccccatccccgtgggcgagatctacaagcgctggatcatcctgggcctgaacaagatcgtgcgcatgtactcccccgtgtccatcctggacatccgccagggccccaaggagcccttccgcgactacgtggaccgcttcttcaagaccctgcgcgccgagcaggccacccaggacgtgaagaactggatgaccgacaccctgctggtgcagaacgccaaccccgactgcaagaccatcctgaaggccctgggccccggcgccaccctggaggagatgatgaccgcctgccagggcgtgggcggccccggccacaaggcccgcgtgctggccgaggccatgtcccaggtgaccaacgccgccatcatgatgcagcgcggcaacttcaagggccagcgccgcatcatcaagtgcttcaactgcggcaaggagggccacatcgcccgcaactgccgcgccccccgcaagaagggctgctggaagtgcggcaaggagggccaccagatgaaggactgcaccgagcgccaggccaacttcctgggcaagatctggccctccaacaagggccgccccggcaacttcctgcagtcccgccccgagcccaccgccccccccgccgagtccttcggcttcggcgaggagatcaccccctcccccaagcaggagcccaaggacaaggagccccccctgacctccctgaagtccctgttcggcaacgaccccctgtcccagtaa

SEQ ID NO: 18 - DNA, 2856 bp, Human immunodeficiency virus
gccgccgccatgccccagatcaccctgtggcagcgccccctggtgaccatcaagatcggcggccagctgaaggaggccctgctggccaccggcgccgacgacaccgtgctggaggagatcaacctgcccggcaagtggaagcccaagatgatcggcggcatcggcggcttcatcaaggtgcgccagtacgaccagatcctgatcgagatctgcggcaagaaggccatcggcaccgtgctggtgggccccacccccgtgaacatcatcggccgcaacatgctgacccagatcggctgcaccctgaacttccccatctcccccatcgagaccgtgcccgtgaagctgaagcccggcatggacggccccaaggtgaagcagtggcccctgaccgaggagaagatcaaggccctgaccgagatctgcaccgagatggagaaggagggcaagatctccaagatcggccccgagaacccctacaacacccccatcttcgccatcaagaagaaggactccaccaagtggcgcaagctggtggacttccgcgagctgaacaagcgcacccaggacttctgggaggtgcagctgggcatcccccaccccgccggcctgaagaagaagaagtccgtgaccgtgctggacgtgggcgacgcctacttctccgtgcccctggacgaggacttccgcaagtacaccgccttcaccatcccctccatcaacaacgagacccccggcatccgctaccagtacaacgtgctgccccagggctggaagggctcccccgccatcttccagtcctccatgaccaagatcctggagcccttccgcacccagaaccccgagatcgtgatctaccagtacatggacgacctgtacgtgggctccgacctggagatcggccagcaccgcgccaagatcgaggagctgcgcgagcacctgctgcgctggggcttcaccacccccgacaagaagcaccagaaggagccccccttcctgtggatgggctacgagctgcaccccgacaagtggaccgtgcagcccatccagctgcccgagaaggactcctggaccgtgaacgacatccagaagctggtgggcaagctgaactgggcctcccagatctaccccggcatcaaggtgaagcagctgtgcaagctgctgcgcggcgccaaggccctgaccgacatcgtgcccctgaccgaggaggccgagctggagctggccgagaaccgcgagatcctgaaggagcccgtgcacggcgtgtactacgacccctccaaggacctgatcgccgagatccagaagcagggccaggaccagtggacctaccagatctaccaggagcccttcaagaacctcaagaccggcaagtacgccaagatgcgctccgcccacaccaacgacgtgaagcagctgaccgaggccgtgcagaagatcgccaccgagtccatcgtgatctggggcaagacccccaagttccgcctgcccatccagaaggagacctgggagacctggtggaccgagtactggcaggccacctggattcccgagtgggagttcgtgaacaccccccccctggtgaagctgtggtaccagctggagaaggagcccatcgccggcgccgagaccttctacgtggacggcgccgccaaccgcgagaccaagctgggcaaggccggctacgtgaccgaccgcggccgccagaaggtggtgtccctgaccgagaccaccaaccagaaaaccgagctgcaggccatccacctggccctgcaggactccggctccgaggtgaacatcgtgaccgactcccagtacgccctgggcatcatccaggcccagcccgacaagtccgagtccgagctggtgaaccagatcatcgagcagctgatcaagaaggagaaggtgtacctgtcctgggtgcccgcccacaagggcatcggcggcaacgagcaggtggacaagctggtgtccaccggcatccgcaaggtgctgttcctggacggcatcgacaaggcccaggaggagcacgagaagtaccactccaactggcgcgccatggcctccgacttcaacctgccccccatcgtggccaaggagatcgtggcctcctgcgacaagtgccagctgaagggcgaggccatgcacggccaggtggactgctcccccggcatctggcagctggactgcacccacctggagggcaagatcatcctggtggccgtgcacgtggcctccggctacatcgaggccgaggtgatccccgccgagaccggccaggagaccgcctacttcatcctgaagctggccggccgctggcccgtgaaggtgatccacaccgacaacggctccaacttcacctccgccgccgtgaaggccgcctgctggtgggccggcatccagcaggagttcggcatcccctacaacccccagtcccagggcgtggtggagtccatgaacaaggagctgaagaagatcatcggccaggtgcgcgaccaggccgagcacctcaagaccgccgtgcagatggccgtgttcatccacaacttcaagcgcaagggcggcatcggcggctactccgccggcgagcgcatcatcgacatcatcgccaccgacatccagaccaaggagctgcagaagcagatcaccaagatccagaacttccgcgtgtactaccgcgactcccgcgaccccatctggaagggccccgccaagctgctgtggaagggcgagggcgccgtggtgatccaggacaactccgacatcaaggtggtgccccgccgcaaggccaagatcatccgcgactacggcaagcagatggccggcgacgactgcgtggccggccgccaggacgaggactaa

SEQ ID NO: 19 - DNA, 633 bp, Human immunodeficiency virus
gccgccgccatgggcggcaagtggtccaagtcctccatcgtgggctggcccgccgtgcgcgagcgcatccgccgcacccaccccgccgccgagggcgtgggcgccgtgtcccaggacctggacaagcacggcgccatcacctcctccaacaccgccgccaacaaccccgactgcgcctggctggaggcccaggaggaggaggaggaggtgggcttccccgtgcgcccccaggtgcccctgcgccccatgacctacaaggccgccctggacctgtcccacttcctgaaggagaagggcggcctggagggcctgatctactccaagaagcgccaggagatcctggacctgtgggtgtaccacacccagggctacttccccgactggcagaactacacccccggccccggcatccgctaccccctgaccttcggctggtgcttcaagctggtgcccgtggaccccgaggaggtggaggaggccaacgagggcgagaacaactccctgctgcaccccatgtgccagcacggcatggaggacgaggagcgcgaggtgctgatgtggaagttcgactcccgcctggccctgcgccacatcgcccgcgagctgcaccccgagtactacaaggactgctaa

SEQ ID NO: 20 - DNA, 2856 bp, Human immunodeficiency virus
gccgccgccatgccccagatcaccctgtggcagcgccccctggtgtccatcaaggtgggcggccagatcaaggaggccctgctggccaccggcgccgacgacaccgtgctggaggagatcaacctgcccggcaagtggaagcccaagatgatcggcggcatcggcggcttcatcaaggtgcgccagtacgaccagatcctgatcgagatctgcggcaagaaggccatcggcaccgtgctggtgggccccacccccgtgaacatcatcggccgcaacatgctgacccagctgggctgcaccctgaacttccccatctcccccatcgagaccgtgcccgtgaagctgaagcccggcatggacggccccaaggtgaagcagtggcccctgaccgaggagaagatcaaggccctgaccgccatctgcgaggagatggagaaggagggcaagatcaccaagatcggccccgagaacccctacaacacccccgtgttcgccatcaagaagaaggactccaccaagtggcgcaagctggtggacttccgcgagctgaacaagcgcacccaggacttctgggaggtgcagctgggcatcccccaccccgccggcctgaagaagaagaagtccgtgaccgtgctggacgtgggcgacgcctacttctccgtgcccctggacgagggcttccgcaagtacaccgccttcaccatcccctccatcaacaacgagacccccggcatccgctaccagtacaacgtgctgccccagggctggaagggctcccccgccatcttccagtcctccatgaccaagatcctggagcccttccgcgcccagaaccccgagatcgtgatctaccagtacatggacgacctgtacgtgggctccgacctggagatcggccagcaccgcgccaagatcgaggagctgcgcgagcacctgctgaagtggggcttcaccacccccgacaagaagcaccagaaggagccccccttcctgtggatgggctacgagctgcaccccgacaagtggaccgtgcagcccatccagctgcccgagaaggactcctggaccgtgaacgacatccagaagctggtgggcaagctgaactgggcctcccagatctaccccggcatcaaggtgcgccagctgtgcaagctgctgcgcggcgccaaggccctgaccgacatcgtgcccctgaccgaggaggccgagctggagctggccgagaaccgcgagatcctgaaggagcccgtgcacggcgtgtactacgacccctccaaggacctgatcgccgagatccagaagcagggccacgaccagtggacctaccagatctaccaggagcccttcaagaacctcaagaccggcaagtacgccaagatgcgcaccgcccacaccaacgacgtgaagcagctgaccgaggccgtgcagaagatcgccatggagtccatcgtgatctggggcaagacccccaagttccgcctgcccatccagaaggagacctgggagacctggtggaccgactactggcaggccacctggattcccgagtgggagttcgtgaacaccccccccctggtgaagctgtggtaccagctggagaaggagcccatcgccggcgccgagaccttctacgtggacggcgccgccaaccgcgagaccaagatcggcaaggccggctacgtgaccgaccgcggccgccagaagatcgtgtccctgaccgagaccaccaaccagaaaaccgagctgcaggccatccagctggccctgcaggactccggctccgaggtgaacatcgtgaccgactcccagtacgccctgggcatcatccaggcccagcccgacaagtccgagtccgagctggtgaaccagatcatcgagcagctgatcaagaaggagcgcgtgtacctgtcctgggtgcccgcccacaagggcatcggcggcaacgagcaggtggacaagctggtgtcctccggcatccgcaaggtgctgttcctggacggcatcgacaaggcccaggaggagcacgagaagtaccactccaactggcgcgccatggcctccgagttcaacctgccccccatcgtggccaaggagatcgtggcctcctgcgacaagtgccagctgaagggcgaggccatgcacggccaggtggactgctcccccggcatctggcagctggactgcacccacctggagggcaagatcatcctggtggccgtgcacgtggcctccggctacatcgaggccgaggtgatccccgccgagaccggccaggagaccgcctacttcatcctgaagctggccggccgctggcccgtgaaggtgatccacaccgacaacggctccaacttcacctccgccgccgtgaaggccgcctgctggtgggccggcatccagcaggagttcggcatcccctacaacccccagtcccagggcgtggtggagtccatgaacaaggagctgaagaagatcatcggccaggtgcgcgaccaggccgagcacctcaagaccgccgtgcagatggccgtgttcatccacaacttcaagcgcaagggcggcatcggcggctactccgccggcgagcgcatcatcgacatcatcgccaccgacatccagaccaaggagctgcagaagcagatcatcaagatccagaacttccgcgtgtactaccgcgactcccgcgaccccatctggaagggccccgccaagctgctgtggaagggcgagggcgccgtggtgatccaggacaactccgacatcaaggtggtgccccgccgcaaggccaagatcatcaaggactacggcaagcagatggccggcgccgactgcgtggccggccgccaggacgaggactaa

SEQ ID NO: 21 - protein, 497 aa, Human immunodeficiency virus
MGARASVLSGGKLDAWEKIRLRPGGKKKYRLKHLVWASRELERFALNPGLLETSEGCKQIIGQLQPALQTGSEELRSLYNTVATLYCVHQRIEVKDTKEALEKIEEEQNKSQQKTQQAAADKGNSSKVSQNYPIVQNLQGQMVHQAISPRTLNAWVKVIEEKAFSPEVIPMFSALSEGATPQDLNTMLNTVGGHQAAMQMLKDTINEEAAEWDRLHPVHAGPIPPGQMREPRGSDIAGTTSTLQEQIAWMTSNPPIPVGEIYKRWIILGLNKIVRMYSPVSILDIRQGPKEPFRDYVDRFFKTLRAEQATQDVKNWMTDTLLVQNANPDCKTILKALGPGATLEEMMTACQGVGGPGHKARVLAEAMSQVTNAAIMMQRGNFKGQRRIIKCFNCGKEGHIARNCRAPRKKGCWKCGKEGHQMKDCTERQANFLGKIWPSNKGRPGNFLQSRPEPTAPPAESFGFGEEITPSPKQEPKDKEPPLTSLKSLFGNDPLSQ

SEQ ID NO: 22 - protein, 948 aa, Human immunodeficiency virus
MPQITLWQRPLVTIKIGGQLKEALLATGADDTVLEEINLPGKWKPKMIGGIGGFIKVRQYDQILIEICGKKAIGTVLVGPTPVNIIGRNMLTQIGCTLNFPISPIETVPVKLKPGMDGPKVKQWPLTEEKIKALTEICTEMEKEGKISKIGPENPYNTPIFAIKKKDSTKWRKLVDFRELNKRTQDFWEVQLGIPHPAGLKKKKSVTVLDVGDAYFSVPLDEDFRKYTAFTIPSINNETPGIRYQYNVLPQGWKGSPAIFQSSMTKILEPFRTQNPEIVIYQYMDDLYVGSDLEIGQHRAKIEELREHLLRWGFTTPDKKHQKEPPFLWMGYELHPDKWTVQPIQLPEKDSWTVNDIQKLVGKLNWASQIYPGIKVKQLCKLLRGAKALTDIVPLTEEAELELAENREILKEPVHGVYYDPSKDLIAEIQKQGQDQWTYQIYQEPFKNLKTGKYAKMRSAHTNDVKQLTEAVQKIATESIVIWGKTPKFRLPIQKETWETWWTEYWQATWIPEWEFVNTPPLVKLWYQLEKEPIAGAETFYVDGAANRETKLGKAGYVTDRGRQKVVSLTETTNQKTELQAIHLALQDSGSEVNIVTDSQYALGIIQAQPDKSESELVNQIIEQLIKKEKVYLSWVPAHKGIGGNEQVDKLVSTGIRKVLFLDGIDKAQEEHEKYHSNWRAMASDFNLPPIVAKEIVASCDKCQLKGEAMHGQVDCSPGIWQLDCTHLEGKIILVAVHVASGYIEAEVIPAETGQETAYFILKLAGRWPVKVIHTDNGSNFTSAAVKAACWWAGIQQEFGIPYNPQSQGVVESMNKELKKIIGQVRDQAEHLKTAVQMAVFIHNFKRKGGIGGYSAGERIIDIIATDIQTKELQKQITKIQNFRVYYRDSRDPIWKGPAKLLWKGEGAVVIQDNSDIKVVPRRKAKIIRDYGKQMAGDDCVAGRQDED

SEQ ID NO: 23 - protein, 207 aa, Human immunodeficiency virus
MGGKWSKSSIVGWPAVRERIRRTHPAAEGVGAVSQDLDKHGAITSSNTAANNPDCAWLEAQEEEEEVGFPVRPQVPLRPMTYKAALDLSHFLKEKGGLEGLIYSKKRQEILDLWVYHTQGYFPDWQNYTPGPGIRYPLTFGWCFKLVPVDPEEVEEANEGENNSLLHPMCQHGMEDEEREVLMWKFDSRLALRHIARELHPEYYKDC

SEQ ID NO: 24 - protein, 948 aa, Human immunodeficiency virus
MPQITLWQRPLVSIKVGGQIKEALLATGADDTVLEEINLPGKWKPKMIGGIGGFIKVRQYDQILIEICGKKAIGTVLVGPTPVNIIGRNMLTQLGCTLNFPISPIETVPVKLKPGMDGPKVKQWPLTEEKIKALTAICEEMEKEGKITKIGPENPYNTPVFAIKKKDSTKWRKLVDFRELNKRTQDFWEVQLGIPHPAGLKKKKSVTVLDVGDAYFSVPLDEGFRKYTAFTIPSINNETPGIRYQYNVLPQGWKGSPAIFQSSMTKILEPFRAQNPEIVIYQYMDDLYVGSDLEIGQHRAKIEELREHLLKWGFTTPDKKHQKEPPFLWMGYELHPDKWTVQPIQLPEKDSWTVNDIQKLVGKLNWASQIYPGIKVRQLCKLLRGAKALTDIVPLTEEAELELAENREILKEPVHGVYYDPSKDLIAEIQKQGHDQWTYQIYQEPFKNLKTGKYAKMRTAHTNDVKQLTEAVQKIAMESIVIWGKTPKFRLPIQKETWETWWTDYWQATWIPEWEFVNTPPLVKLWYQLEKEPIAGAETFYVDGAANRETKIGKAGYVTDRGRQKIVSLTETTNQKTELQAIQLALQDSGSEVNIVTDSQYALGIIQAQPDKSESELVNQIIEQLIKKERVYLSWVPAHKGIGGNEQVDKLVSSGIRKVLFLDGIDKAQEEHEKYHSNWRAMASEFNLPPIVAKEIVASCDKCQLKGEAMHGQVDCSPGIWQLDCTHLEGKIILVAVHVASGYIEAEVIPAETGQETAYFILKLAGRWPVKVIHTDNGSNFTSAAVKAACWWAGIQQEFGIPYNPQSQGVVESMNKELKKIIGQVRDQAEHLKTAVQMAVFIHNFKRKGGIGGYSAGERIIDIIATDIQTKELQKQIIKIQNFRVYYRDSRDPIWKGPAKLLWKGEGAVVIQDNSDIKVVPRRKAKIIKDYGKQMAGADCVAGRQDED

SEQ ID NO: 25 - DNA, 1512 bp, Human immunodeficiency virus
gccgccgccatgggcgcccgcgcctccgtgctgtccggcggcgagctggaccgctgggagaagatccgcctgcgccccggcggcaagaagaagtacaagctgaagcacatcgtgtgggcctcccgcgagctggagcgcttcgccgtgaaccccggcctgctggagacctccgagggctgccgccagatcctgggccagctgcagccctccctgcagaccggctccgaggagctgcgctccctgtacaacaccgtggccaccctgtactgcgtgcaccagcgcatcgaggtgaaggacaccaaggaggccctggagaagatcgaggaggagcagaacaagtccaagaagaaggcccagcaggccgccgccgacaccggcaactcctcccaggtgtcccagaactaccccatcgtgcagaacctgcagggccagatggtgcaccaggccatctccccccgcaccctgaacgcctgggtgaaggtggtggaggagaaggccttctcccccgaggtgatccccatgttctccgccctgtccgagggcgccaccccccaggacctgaacaccatgctgaacaccgtgggcggccaccaggccgccatgcagatgctgaaggagaccatcaacgaggaggccgccgagtgggaccgcctgcaccccgtgcacgccggccccatcgcccccggccagatgcgcgagccccgcggctccgacatcgccggcaccacctccaccctgcaggagcagatcggctggatgaccaacaacccccccatccccgtgggcgagatctacaagcgctggatcatcctgggcctgaacaagatcgtgcgcatgtactcccccacctccatcctggacatccgccagggccccaaggagcccttccgcgactacgtggaccgcttctacaagaccctgcgcgccgagcaggcctcccaggaggtgaagaactggatgaccgagaccctgctggtgcagaacgccaaccccgactgcaagaccatcctgaaggccctgggccccgccgccaccctggaggagatgatgaccgcctgccagggcgtgggcggccccggccacaaggcccgcgtgctggccgaggccatgtcccaggtgaccaactccgccaccatcatgatgcagcgcggcaacttccgcaaccagcgcaagaccgtgaagtgcttcaactgcggcaaggagggccacatcgccaagaactgccgcgccccccgcaagaagggctgctggaagtgcggcaaggagggccaccagatgaaggactgcaccgagcgccaggccaacttcctgggcaagatctggccctcccacaagggccgccccggcaacttcctgcagtcccgccccgagcccaccgccccccccgaggagtccttccgcttcggcgaggagaccaccaccccctcccagaagcaggagcccatcgacaaggagctgtaccccctggcctccctgcgctccctgttcggcaacgacccctcctcccagtaa

SEQ ID NO: 26 - DNA, 2562 bp, Human immunodeficiency virus
gccgccgccatgcgcgtgaagggcatccgcaagaactaccagcacctgtggcgctggggcaccatgctgctgggcatgctgatgatctgctccgccgccgagaagctgtgggtgaccgtgtactacggcgtgcccgtgtggaaggaggccaccaccaccctgttctgcgcctccgacgccaaggcctacgacaccgaggtgcacaacgtgtgggccacccacgcctgcgtgcccaccgaccccaacccccaggaggtggtgctggagaacgtgaccgagaacttcaacatgtggaagaacaacatggtggagcagatgcacgaggacatcatctccctgtgggaccagtccctgaagccctgcgtgaagctgacccccctgtgcgtgaccctgaactgcaccgacctgaagaacaacctgctgaacaccaactcctcctccggcgagaagatggagaagggcgagatcaagaactgctccttcaacatcaccacctccatccgcgacaaggtgcagaaggagtacgccctgttctacaagctggacgtggtgcccatcgacaacaacaacaacacctcctaccgcctgatctcctgcaacacctccgtgatcacccaggcctgccccaaggtgtccttcgagcccatccccatccactactgcgcccccgccggcttcgccatcctgaagtgcaacgacaagaagttcaacggcaccggcccctgcaccaacgtgtccaccgtgcagtgcacccacggcatccgccccgtggtgtccacccagctgctgctgaacggctccctggccgaggaggaggtggtgatccgctccgagaacttcaccgacaacgccaagaccatcatcgtgcagctgaacgagtccgtggagatcaactgcacccgccccaacaacaacacccgcaagtccatccacatcggccccggccgcgccttctacaccaccggcgagatcatcggcgacatccgccaggcccactgcaacatctcccgcgccaagtggaacaacaccctgaagcagatcgtgaagaagctgcgcgagcagttcggcaacaagaccatcgtgttcaaccagtcctccggcggcgaccccgagatcgtgatgcactccttcaactgcggcggcgagttcttctactgcaacaccacccagctgttcaactccacctggaacgacaacggcacctggaacaacaccaaggacaagaacaccatcaccctgccctgccgcatcaagcagatcatcaacatgtggcaggaggtgggcaaggccatgtacgccccccccatccgcggccagatccgctgctcctccaacatcaccggcctgctgctgacccgcgacggcggcaacaacaacaacgacaccgagatcttccgccccggcggcggcgacatgcgcgacaactggcgctccgagctgtacaagtacaaggtggtgaagatcgagcccctgggcgtggcccccaccaaggccaagcgccgcgtggtgcagcgcgagaagcgcgccgtgggcatcggcgccatgttcctgggcttcctgggcgccgccggctccaccatgggcgccgcctccatgaccctgaccgtgcaggcccgccagctgctgtccggcatcgtgcagcagcagaacaacctgctgcgcgccatcgaggcccagcagcacctgctgcagctgaccgtgtggggcatcaagcagctgcaggcccgcgtgctggccgtggagcgctacctgaaggaccagcagctgctgggcatctggggctgctccggcaagctgatctgcaccaccaccgtgccctggaacgcctcctggtccaacaagtccctggacgagatctgggacaacatgacctggatggagtgggagcgcgagatcgacaactacacctccctgatctacaccctgatcgaggagtcccagaaccagcaggagaagaacgagcaggagctgctggagctggacaagtgggcctccctgtggaactggttcgacatcaccaactggctgtggtacatcaagatcttcatcatgatcgtgggcggcctgatcggcctgcgcatcgtgttcgccgtgctgtccatcgtgaaccgcgtgcgccagggctactcccccctgtccttccagacccgcctgcccgccccccgcggccccgaccgccccgagggcatcgaggaggagggcggcgagcgcgaccgcgaccgctccggccgcctggtggacggcttcctggccctgatctgggacgacctgcgctccctgtgcctgttctcctaccaccgcctgcgcgacctgctgctgatcgtgacccgcatcgtggagctgctgggccgccgcggctgggaggtgctgaagtactggtggaacctgctgcagtactggtcccaggagctgaagaactccgccgtgtccctgctgaacgccaccgccatcgccgtggccgagggcaccgaccgcgtgatcgaggtggtgcagcgcgcctgccgcgccatcctgcacatcccccgccgcatccgccagggcctggagcgcgccctgctgtaa

SEQ ID NO: 27 - skipped

SEQ ID NO: 28 - protein, 500 aa, Human immunodeficiency virus
MGARASVLSGGELDRWEKIRLRPGGKKKYKLKHIVWASRELERFAVNPGLLETSEGCRQILGQLQPSLQTGSEELRSLYNTVATLYCVHQRIEVKDTKEALEKIEEEQNKSKKKAQQAAADTGNSSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSATIMMQRGNFRNQRKTVKCFNCGKEGHIAKNCRAPRKKGCWKCGKEGHQMKDCTERQANFLGKIWPSHKGRPGNFLQSRPEPTAPPEESFRFGEETTTPSQKQEPIDKELYPLASLRSLFGNDPSSQ

SEQ ID NO: 29 - protein, 850 aa, Human immunodeficiency virus
MRVKGIRKNYQHLWRWGTMLLGMLMICSAAEKLWVTVYYGVPVWKEATTTLFCASDAKAYDTEVHNVWATHACVPTDPNPQEVVLENVTENFNMWKNNMVEQMHEDIISLWDQSLKPCVKLTPLCVTLNCTDLKNNLLNTNSSSGEKMEKGEIKNCSFNITTSIRDKVQKEYALFYKLDVVPIDNNNNTSYRLISCNTSVITQACPKVSFEPIPIHYCAPAGFAILKCNDKKFNGTGPCTNVSTVQCTHGIRPVVSTQLLLNGSLAEEEVVIRSENFTDNAKTIIVQLNESVEINCTRPNNNTRKSIHIGPGRAFYTTGEIIGDIRQAHCNISRAKWNNTLKQIVKKLREQFGNKTIVFNQSSGGDPEIVMHSFNCGGEFFYCNTTQLFNSTWNDNGTWNNTKDKNTITLPCRIKQIINMWQEVGKAMYAPPIRGQIRCSSNITGLLLTRDGGNNNNDTEIFRPGGGDMRDNWRSELYKYKVVKIEPLGVAPTKAKRRVVQREKRAVGIGAMFLGFLGAAGSTMGAASMTLTVQARQLLSGIVQQQNNLLRAIEAQQHLLQLTVWGIKQLQARVLAVERYLKDQQLLGIWGCSGKLICTTTVPWNASWSNKSLDEIWDNMTWMEWEREIDNYTSLIYTLIEESQNQQEKNEQELLELDKWASLWNWFDITNWLWYIKIFIMIVGGLIGLRIVFAVLSIVNRVRQGYSPLSFQTRLPAPRGPDRPEGIEEEGGERDRDRSGRLVDGFLALIWDDLRSLCLFSYHRLRDLLLIVTRIVELLGRRGWEVLKYWWNLLQYWSQELKNSAVSLLNATAIAVAEGTDRVIEVVQRACRAILHIPRRIRQGLERALL

SEQ ID NO: 30 - protein, 610 aa, Human immunodeficiency virus
MRVRGIQRNCQHLWRWGTLILGMLMICSAAENLWVTVYYGVPVWKEANTTLFCASDAKAYDTEVHNVWATHACVPTDPNPQEIVLENVTENFNMWKNNMVEQMHEDIISLWDQSLKPCVKLTPLCVTLNCTNVNVTNTTNNTEEKGEIKNCSFNITTEIRDKKQKVYALFYRLDVVPIDDNNNNSSNYRLINCNTSAITQACPKVSFEPIPIHYCAPAGFAILKCNDKKFNGTGPCKNVSTVQCTHGIKPVVSTQLLLNGSLAEEEIIIRSENITNNAKTIIVQLNESVEINCTRPNNNTRKSIRIGPGQAFYATGDIIGDIRQAHCNISGTKWNKTLQQVAKKLREHFNNKTIIFKPSSGGDLEITTHSFNCRGEFFYCNTSGLFNSTWIGNGTKNNNNTNDTITLPCRIKQIINMWQGVGQAMYAPPIEGKITCKSNITGLLLTRDGGNNNTNETEIFRPGGGDMRDNWRSELYKYKVVKIEPLGVAPTKAKLTVQARQLLSGIVQQQSNLLRAIEAQQHLLQLTVWGIKQLQARVLAVERYLKDQQLEIWDNMTWMEWEREINNYTDIIYSLIEESQNQQEKNEQELLALDKWASLWNWFDITNWLW

SEQ ID NO: 31 - DNA, 1837 bp, Human immunodeficiency virus
atgcgcgtgcgcggcatccagcgcaactgccagcacctgtggcgctggggcacctgatcctgggcatgctgatgatctgctccgccgccgagaacctgtgggtgaccgtgtactacggcgtgcccgtgtggaaggaggccaacaccaccctgttctgcgcctccgacgccaaggcctacgacaccgaggtgcacaacgtgtgggccacccacgcctgcgtgcccaccgaccccaacccccaggagatcgtgctggagaacgtgaccgagaacttcaacatgtggaagaacaacatggtggagcagatgcacgaggacatcatctccctgtgggaccagtccctgaagccctgcgtgaagctgacccccctgtgcgtgaccctgaactgcaccaacgtgaacgtgaccaacaccaccaacaacaccgaggagaagggcgagatcaagaactgctccttcaacatcaccaccgagatccgcgacaagaagcagaaggtgtacgccctgttctaccgcctggacgtggtgcccatcgacgacaacaacaacaactcctccaactaccgcctgatcaactgcaacacctccgccatcacccaggcctgccccaaggtgtccttcgagcccatccccatccactactgcgcccccgccggcttcgccatcctgaagtgcaacgacaagaagttcaacggcaccggcccctgcaagaacgtgtccaccgtgcagtgcacccacggcatcaagcccgtggtgtccacccagctgctgctgaacggctccctggccgaggaggagatctcatccgctccgagaacatcaccaacaacgccaagaccatcatcgtgcagctgaacgagtccgtggagatcaactgcacccgccccaacaacaacacccgcaagtccatccgcatcggccccggccaggccttctacgccaccggcgacatcatcggcgacatccgccaggcccactgcaacatctccggcaccaagtggaacaagaccctgcagcaggtggccaagaagctgcgcgagcacttcaacaacaagaccatcatcttcaagccctcctccggcggcgacctggagatcaccacccactccttcaactgccgcggcgagttcttctactgcaacacctccggcctgttcaactccacctggatcggcaacggcaccaagaacaacaacaacaccaacgacaccatcaccctgccctgccgcatcaagcagatcatcaacatgtggcagggcgtgggccaggccatgtacgccccccccatcgagggcaagatcacctgcaagtccaacatcaccggcctgctgctgacccgcgacggcggcaacaacaacaccaacgagaccgagatcttccgccccggcggcggcgacatgcgcgacaactggcgctccgagctgtacaagtacaaggtggtgaagatcgagcccctgggcgtggcccccaccaaggccaagcttaccgtgcaggcccgccagctgctgtccggcatcgtgcagcagcagtccaacctgctgcgcgccatcgaggcccagcagcacctgctgcagctgaccgtgtggggcatcaagcagctgcaggcccgcgtgctggccgtggagcgctacctgaaggaccagcagctcgagatctgggacaacatgacctggatggagtgggagcgcgagatcaacaactacaccgacatcatctactccctgatcgaggagtcccagaaccagcaggagaagaacgagcaggagctgctggccctggacaagtgggcctccctgtggaactggttcgacatcaccaactggctgtggtgaggatcc

SEQ ID NO: 32 - protein, 841 aa, Human immunodeficiency virus
MRVKGIRKNYQHLWRWGTMLLGMLMICSAAEKLWVTVYYGVPVWKEATTTLFCASDAKAYDTEVHNVWATHACVPTDPNPQEVVLENVTENFNMWKNNMVEQMHEDIISLWDQSLKPCVKLTPLCVTLNCTDLMNATNTNTTIIYRWRGEIKNCSFNITTSIRDKVQKEYALFYKLDVVPIDNDNTSYRLISCNTSVITQACPKVSFEPIPIHYCAPAGFAILKCNDKKFNGTGPCTNVSTVQCTHGIRPVVSTQLLLNGSLAEEEVVIRSENFTDNAKTIIVQLNESVEINCTRPNNNTRKSIHIGPGRAFYTTGEIIGDIRQAHCNISRAKWNNTLKQIVKKLREQFGNKTIVFNQSSGGDPEIVMHSFNCGGEFFYCNTTQLFNSTWNGTWNNTEGNITLPCRIKQIINMWQEVGKAMYAPPIRGQIRCSSNITGLLLTRDGGNNETEIFRPGGGDMRDNWRSELYKYKVVKIEPLGVAPTKAKRRVVQREKRAVGIGAMFLGFLGAAGSTMGAASMTLTVQARQLLSGIVQQQNNLLRAIEAQQHLLQLTVWGIKQLQARVLAVERYLKDQQLLGIWGCSGKLICTTAVPWNASWSNKSLDEIWDNMTWMEWEREIDNYTSLIYTLIEESQNQQEKNEQELLELDKWASLWNWFDITNWLWYIKIFIMIVGGLVGLRIVFAVLSIVNRVRQGYSPLSFQTRLPAPRGPDRPEGIEEEGGERDRDRSGRLVDGFLALIWDDLRSLCLFSYHRLRDLLLIVTRIVELLGRRGWEVLKYWWNLLQYWSQELKNSAVSLLNATAIAVAEGTDRVIEVVQRACRAILHIPRRIRQGLERALL

SEQ ID NO: 33 - protein, 632 aa, Human immunodeficiency virus
MRVKGIRKNYQHLWRWGTMLLGMLMICSAAEKLWVTVYYGVPVWKEATTTLFCASDAKAYDTEVHNVWATHACVPTDPNPQEVVLENVTENFNMWKNNMVEQMHEDIISLWDQSLKPCVKLTPLCVTLNCTDLMNATNTNTTIIYRWRGEIKNCSFNITTSIRDKVQKEYALFYKLDVVPIDNDNTSYRLISCNTSVITQACPKVSFEPIPIHYCAPAGFAILKCNDKKFNGTGPCTNVSTVQCTHGIRPVVSTQLLLNGSLAEEEVVIRSENFTDNAKTIIVQLNESVEINCTRPNNNTRKSIHIGPGRAFYTTGEIIGDIRQAHCNISRAKWNNTLKQIVKKLREQFGNKTIVFNQSSGGDPEIVMHSFNCGGEFFYCNTTQLFNSTWNGTWNNTEGNITLPCRIKQIINMWQEVGKAMYAPPIRGQIRCSSNITGLLLTRDGGNNETEIFRPGGGDMRDNWRSELYKYKVVKIEPLGVAPTKAKTLTVQARQLLSGIVQQQNNLLRAIEAQQHLLQLTVWGIKQLQARVLAVERYLKDQQLLGIWGCSGKLICTTAVPWNASWSNKSLDEIWDNMTWMEWEREIDNYTSLIYTLIEESQNQQEKNEQELLELDKWASLWNWFDITNWLW

SEQ ID NO: 34 - DNA, 1927 bp, Human immunodeficiency virus
ttcagtcgacggccaccatgagggtgaagggtattcggaaaaattaccaacacctgtggcgctggggaaccatgctccttggtatgctgatgatttgcagtgccgccgagaaactttgggtaactgtgtactacggcgttcctgtctggaaggaagctacaaccactcttttttgtgcatccgacgctaaagcttacgacacagaagtgcataatgtttgggccacccatgcttgcgtccctacagatcccaacccccaggaagtcgtccttgagaatgtcacagagaattttaacatgtggaagaataatatggtagaacaaatgcacgaagacattattagcctgtgggaccagtccttgaagccctgcgtgaaactcactccactttgcgtcacacttaactgtactgatttgatgaacgcaaccaacacaaatactactattatatatcgctggaggggggaaatcaagaactgctctttcaacatcaccacttccataagggataaggtccagaaagaatatgccctgttttataaacttgatgtggtcccgatagacaatgacaacactagctatcgactgatctcttgtaacacatccgtgattacccaagcttgcccaaaggtcagctttgaaccaatacccattcactactgcgctcccgctggttttgccatcctcaagtgtaacgacaaaaaattcaatgggaccggaccttgcacaaacgtgtccaccgtgcaatgtactcacggaatcagacctgttgtcagtacccaactcctcttgaacgggtctctcgcggaagaggaggtcgtgattagaagcgaaaactttaccgataacgctaaaacaatcattgtgcaacttaatgaaagcgtcgaaattaactgcaccagaccaaacaataataccagaaaatctattcacatagggcccggccgcgcattttatacaactggcgaaatcattggtgacatcagacaagctcattgcaatatctcccgcgcgaaatggaacaacaccctgaaacagatcgtgaagaaacttcgagaacaattcggtaataaaacaatcgtattcaaccaaagctccggaggcgaccctgagatagttatgcactcattcaactgtggcggcgagttcttctattgtaacacaactcaactttttaatagcacttggaatggaacatggaacaacacagaagggaacatcactctgccttgtcggattaagcagatcattaatatgtggcaagaagtgggaaaagctatgtacgccccgcctattcgcggacaaataagatgctctagtaatattaccggattgttgctgacacgcgacggaggaaataatgaaacagagatatttagacctggcggaggcgacatgagagataactggagaagtgagctttacaaatataaagtcgtaaagatagaaccattgggggtagcaccaaccaaagcaaaaaccttgacagtacaggctaggcagctgctgagcggaatcgtgcaacaacaaaataatcttctccgagccatagaagcacaacaacatctgttgcagctgacagtatggggaatcaaacagcttcaggcaagagtgctggccgtcgagagatacctcaaagatcaacaactgctgggcatatggggatgttccggtaaactcatatgcactaccgccgtgccctggaacgcgagctggtctaataaatccctggatgaaatttgggacaacatgacttggatggaatgggaacgggaaattgacaactatactagtttgatttatactctgatcgaagaatctcagaaccaacaggagaaaaacgaacaggaactgctggaactggacaagtgggcatcattgtggaactggtttgacattactaactggctgtggtaaagatcttacaa

SEQ ID NO: 35 - protein, 829 aa, Human immunodeficiency virus
MRVMGIQRNCQHLWRWGILIFGMLIICSAAENLWVTVYYGVPVWKEANTTLFCASDAKAYDTEVHNVWATHACVPTDPNPQEIVLENVTENFNMWKNNMVEQMHEDIISLWDQSLKPCVKLTPLCVTLNCTDVNATNNTTNNEEIKNCSFNITTEIRDKKKKVYALFYKLDVVPIDDNNSYRLINCNTSAITQACPKVSFEPIPIHYCAPAGFAILKCNDKKFNGTGPCKNVSTVQCTHGIKPVVSTQLLLNGSLAEEEIIIRSENITNNAKTIIVQLNESVEINCTRPNNNTRKSIRIGPGQAFYATGDIIGDIRQAHCNISRTKWNKTLQQVAKKLREHFNKTIIFNPSSGGDLEITTHSFNCGGEFFYCNTSELFNSTWNGTNNTITLPCRIKQIINMWQGVGQAMYAPPIEGKIRCTSNITGLLLTRDGGNNNTETFRPGGGDMRDNWRSELYKYKVVKIEPLGVAPTKAKRRVVEREKRAVGIGAVFLGFLGAAGSTMGAASITLTVQARQLLSGIVQQQSNLLRAIEAQQHLLQLTVWGIKQLQARVLAVERYLKDQQLLGIWGCSGKLICTTNVPWNSSWSNKSQDEIWDNMTWMEWDKEINNYTDIIYSLIEESQNQQEKNEQELLALDKWASLWNWFDITNWLWYIKIFIMIVGGLIGLRIVFAVLSIVNRVRQGYSPLSFQTLIPNPRGPDRPEGIEEEGGEQDRDRSIRLVNGFLALAWDDLRSLCLFSYHRLRDLILIAARTVELLGRRGWEALKYLWNLLQYWGQELKNSAISLLDTTAIAVAEGTDRVIEVVQRVCRAILNIPRRIRQGFERALL

SEQ ID NO: 36 - protein, 620 aa, Human immunodeficiency virus
MRVMGIQRNCQHLWRWGILIFGMLIICSAAENLWVTVYYGVPVWKEANTTLFCASDAKAYDTEVHNVWATHACVPTDPNPQEIVLENVTENFNMWKNNMVEQMHEDIISLWDQSLKPCVKLTPLCVTLNCTDVNATNNTTNNEEIKNCSFNITTEIRDKKKKVYALFYKLDVVPIDDNNSYRLINCNTSAITQACPKVSFEPIPIHYCAPAGFAILKCNDKKFNGTGPCKNVSTVQCTHGIKPVVSTQLLLNGSLAEEEIIIRSENITNNAKTIIVQLNESVEINCTRPNNNTRKSIRIGPGQAFYATGDIIGDIRQAHCNISRTKWNKTLQQVAKKLREHFNKTIIFNPSSGGDLEITTHSFNCGGEFFYCNTSELFNSTWNGTNNTITLPCRIKQIINMWQGVGQAMYAPPIEGKIRCTSNITGLLLTRDGGNNNTETFRPGGGDMRDNWRSELYKYKVVKIEPLGVAPTKAKTLTVQARQLLSGIVQQQSNLLRAIEAQQHLLQLTVWGIKQLQARVLAVERYLKDQQLLGIWGCSGKLICTTNVPWNSSWSNKSQDEIWDNMTWMEWDKEINNYTDIIYSLIEESQNQQEKNEQELLALDKWASLWNWFDITNWLW

SEQ ID NO: 37 - DNA, 1891 bp, Human immunodeficiency virus
ttcagtcgacagccaccatgcgggtcatggggatacagaggaattgccagcacttgtggaggtggggaattttgatattcgggatgctcataatctgctctgccgctgagaacctgtgggtcactgtgtattacggcgttcccgtctggaaagaagctaatactaccctgttttgtgcaagcgacgccaaagcatacgacaccgaagtccacaatgtctgggctacccacgcctgtgtacctactgatccaaatccccaggaaattgttcttgaaaacgtaacggaaaactttaacatgtggaagaataatatggtggagcaaatgcacgaggatataatcagcctgtgggaccagtccctcaaaccatgcgttaaactcactccactctgcgtgactctgaactgtaccgacgtgaacgcaaccaataatacaacaaacaatgaggagataaagaattgttcatttaatataaccactgagatacgggataagaaaaaaaaggtttatgcactcttttacaagctcgacgtggtgcccatagacgacaataatagctaccgactcattaattgcaatactagcgctataacccaggcatgccccaaagtttccttcgagcccataccgattcactactgcgcacccgccggattcgccattcttaaatgcaatgacaagaagttcaacggcaccggaccctgtaagaacgtaagcactgttcaatgtacacatggaattaagccggtagtgtcaacgcagctcctcctcaacggaagccttgcagaagaagagatcattatcaggtcagaaaatatcactaacaacgcgaaaacaatcattgttcagctgaatgagtctgtagaaatcaattgtacccgccctaataataacacaagaaagtcaattaggatcggacccggccaggctttctacgcaaccggagatatcatcggggatatacgacaggcccactgcaacatttctagaactaagtggaataaaactttgcagcaggtagccaagaaactgcgggaacattttaataagacaatcatcttcaatccaagtagcggaggggacctggaaatcactacacattcctttaactgtgggggcgagtttttctactgtaatacctctgaactgttcaactcaacatggaatggcactaacaatactataactcttccttgcagaataaaacagattatcaacatgtggcagggtgtggggcaagcaatgtatgcaccaccaatcgaaggcaaaataagatgcacctccaatattaccggactcctcctgacacgggatggcggaaacaataacacggagacctttaggccaggcggcggcgatatgagagataactggcgctccgagctctataaatacaaagtcgttaagatcgagccccttggagttgcgccaaccaaagctaaaaccttgaccgtgcaagccaggcagttgttgtcaggtatcgtacagcagcaatctaatcttttgagagccattgaggctcagcagcacctcttgcagcttaccgtctggggcatcaaacaacttcaggcacgcgtcctggccgtagagcgctatttgaaagaccaacaacttctcgggatctgggggtgttctggaaaattgatctgcacgacaaatgtgccttggaacagcagctggtcaaataaaagccaagacgaaatatgggataacatgacatggatggaatgggataaagaaattaataattacactgacattatttactcacttatcgaggaatcacaaaatcaacaggaaaaaaatgaacaggaactcttggctctggacaaatgggcttcactgtggaactggttcgacatcacaaattggctctggtaaagatcttacaa

SEQ ID NO: 38 - protein, 845 aa, Human immunodeficiency virus
MRVMGIQRNCQHLLRWGTMILGMIIICSAAENLWVTVYYGVPVWKDAETTLFCASDAKAYETEMHNVWATHACVPTDPNPQEIHLENVTEEFNMWKNNMVEQMHTDIISLWDQSLKPCVKLTPLCVTLNCSNVNVTNNTTNTHEEEIKNCSFNMTTELRDKKQKVYSLFYRLDVVQINENNSNSSYRLINCNTSAITQACPKVSFEPIPIHYCAPAGFAILKCKDKEFNGTGPCKNVSTVQCTHGIKPVVSTQLLLNGSLAEEEVIIRSENITNNAKTIIVQLTKPVKINCTRPNNNTRKSIRIGPGQAFYATGDIIGDIRQAHCNVSRSEWNKTLQKVAKQLRKYFKNKTIIFTNSSGGDLEITTHSFNCGGEFFYCNTSGLFNSTWNNGTMKNTITLPCRIKQIINMWQRAGQAMYAPPIQGVIRCESNITGLLLTRDGGNNNTNETFRPGGGDMRDNWRSELYKYKVVKIEPLGVAPTRAKRRVVEREKRAVGIGAVFLGFLGAAGSTMGAASITLTVQARQLLSGIVQQQSNLLRAIEAQQHLLKLTVWGIKQLQARVLAVERYLKDQQLLGIWGCSGKLICTTNVPWNSSWSNKSQNEIWDNMTWLQWDKEISNYTHIIYNLIEESQNQQEKNEQDLLALDKWANLWNWFDISNWLWYIKIFIMIVGGLIGLRIVFAVLSVINRVRQGYSPLSFQTHTPNPRGLDRPGRIEEEGGEQGRDRSIRLVSGFLALAWDDLRSLCLFSYHRLRDFILIAARTVELLGHSSLKGLRLGWEGLKYLWNLLLYWGRELKISAINLVDTIAIAVAGWTDRVIEIGQRIGRAILHIPRRIRQGLERALL

SEQ ID NO: 39 - protein, 629 aa, Human immunodeficiency virus
MRVMGIQRNCQHLLRWGTMILGMIIICSAAENLWVTVYYGVPVWKDAETTLFCASDAKAYETEMHNVWATHACVPTDPNPQEIHLENVTEEFNMWKNNMVEQMHTDIISLWDQSLKPCVKLTPLCVTLNCSNVNVTNNTTNTHEEEIKNCSFNMTTELRDKKQKVYSLFYRLDVVQINENNSNSSYRLINCNTSAITQACPKVSFEPIPIHYCAPAGFAILKCKDKEFNGTGPCKNVSTVQCTHGIKPVVSTQLLLNGSLAEEEVIIRSENITNNAKTIIVQLTKPVKINCTRPNNNTRKSIRIGPGQAFYATGDIIGDIRQAHCNVSRSEWNKTLQKVAKQLRKYFKNKTIIFTNSSGGDLEITTHSFNCGGEFFYCNTSGLFNSTWNNGTMKNTITLPCRIKQIINMWQRAGQAMYAPPIQGVIRCESNITGLLLTRDGGNNNTNETFRPGGGDMRDNWRSELYKYKVVKIEPLGVAPTRAKTLTVQARQLLSGIVQQQSNLLRAIEAQQHLLKLTVWGIKQLQARVLAVERYLKDQQLLGIWGCSGKLICTTNVPWNSSWSNKSQNEIWDNMTWLQWDKEISNYTHIIYNLIEESQNQQEKNEQDLLALDKWANLWNWFDISNWLW

SEQ ID NO: 40 - DNA, 1918 bp, Human immunodeficiency virus
ttcagtcgacagccaccatgagggtgatgggaatccaacggaactgccagcatcttctccggtggggaacgatgatactgggaatgataataatctgctctgccgctgaaaacctctgggtcacagtgtactacggagtgcctgtatggaaggacgctgaaaccactctcttttgtgcttccgatgctaaagcctacgaaaccgagatgcacaatgtttgggccacccacgcctgcgtgccaactgatcctaatccacaagaaatacatctggagaatgttactgaggaatttaacatgtggaaaaataatatggtagagcaaatgcacactgacatcatttcactctgggaccaatcactcaaaccctgcgttaaacttacccccctctgcgtgaccctcaattgtagcaacgtcaacgtcacaaataatacaaccaacactcacgaggaagaaattaaaaattgctcctttaatatgaccactgaacttcgcgacaaaaaacaaaaagtctattcactgttttataggctggacgtcgtccaaatcaacgagaacaattctaacagtagctatcgacttatcaattgcaatacctctgctattacccaagcttgtcctaaagtctcttttgaaccaatccctatccactactgtgccccagctggattcgcaattctgaagtgcaaggataaggaattcaacggaactggcccttgcaagaacgttagcactgtccaatgcactcacggaatcaaaccagtagtcagcactcaactgctcctgaatggctcactcgccgaagaagaggtgattatccgaagcgagaacataactaacaatgcgaagacaataattgttcaattgacgaaaccagtgaagatcaactgtactagaccaaataacaacacaagaaaatctatcagaattggccccggacaagccttctacgcaacaggagatatcataggtgacatcagacaggcccattgcaacgtttcaagaagcgagtggaataaaacactccagaaagtggcaaagcagctgagaaaatactttaagaacaagacaatcatatttactaactcctccggaggtgatctcgaaataaccactcatagctttaattgtgggggcgaattcttctactgtaacacatctggcctctttaattctacctggaataacggcaccatgaaaaatactatcaccctcccttgcagaattaagcaaatcattaacatgtggcagagagcaggacaggccatgtatgcccctcccattcaaggtgtgattcgatgtgaaagcaacattactggacttcttctgacccgggatggcggaaataataataccaatgagacattcagacccggcggcggcgatatgcgagacaattggcgaagtgaactttataaatacaaagtagttaagattgagccccttggagttgcccctactagagcaaaaacattgaccgttcaggccaggcagctgctctcaggaatcgtgcagcagcaaagtaacctcctccgagctatcgaggcacaacaacatctcttgaaattgaccgtatggggaatcaagcaattgcaggctagggttttggctgtggaacgctatctcaaggatcagcagcttctgggaatctggggatgctctgggaaattgatatgtactacaaacgtaccctggaactcaagctggagtaataaaagccagaacgaaatttgggataatatgacctggctgcagtgggacaaagaaatttctaattatactcatatcatatacaatctgatcgaagaatcacagaaccagcaggaaaagaatgagcaagaccttctggccttggacaagtgggctaacttgtggaactggtttgacattagcaactggctgtggtaaagatcttacaa

SEQ ID NO: 41 - protein, 835 aa, Human immunodeficiency virus
MRVRGILRNCQQWWIWGILGFWMLMICNVVGNLWVTVYYGVPVWKEAKTTLFCASDAKAYEKEVHNVWATHACVPTDPNPQEIVLENVTENFNMWKNDMVDQMHEDIISLWDQSLKPCVKLTPLCVTLNCTNATNATNTMGEIKNCSFNITTELRDKKQKVYALFYRLDIVPLNENNSYRLINCNTSAITQACPKVSFDPIPIHYCAPAGYAILKCNNKTFNGTGPCNNVSTVQCTHGIKPVVSTQLLLNGSLAEEEIIIRSENLTNNAKTIIVHLNESVEIVCTRPNNNTRKSIRIGPGQTFYATGDIIGDIRQAHCNISEDKWNKTLQKVSKKLKEHFPNKTIKFEPSSGGDLEITTHSFNCRGEFFYCNTSKLFNSTYNSTNSTITLPCRIKQIINMWQEVGRAMYAPPIAGNITCKSNITGLLLTRDGGKNNTETFRPGGGDMRDNWRSELYKYKVVEIKPLGIAPTKAKRRVVEREKRAVGIGAVFLGFLGAAGSTMGAASITLTVQARQLLSGIVQQQSNLLRAIEAQQHMLQLTVWGIKQLQTRVLAIERYLKDQQLLGIWGCSGKLICTTAVPWNSSWSNKSQEDIWDNMTWMQWDREISNYTDTIYRLLEDSQNQQEKNEKDLLALDSWKNLWNWFDITNWLWYIKIFIMIVGGLIGLRIIFAVLSIVNRVRQGYSPLSFQTLTPNPRGPDRLGRIEEEGGEQDRDRSIRLVSGFLALAWDDLRSLCLFSYHRLRDFILIAARAVELLGRSSLRGLQRGWEALKYLGSLVQYWGLELKKSAISLLDTIAIAVAEGTDRIIELIQRICRAIRNIPRRIRQGFEAALQ

SEQ ID NO: 42 - protein, 619 aa, Human immunodeficiency virus
MRVRGILRNCQQWWIWGILGFWMLMICNVVGNLWVTVYYGVPVWKEAKTTLFCASDAKAYEKEVHNVWATHACVPTDPNPQEIVLENVTENFNMWKNDMVDQMHEDIISLWDQSLKPCVKLTPLCVTLNCTNATNATNTMGEIKNCSFNITTELRDKKQKVYALFYRLDIVPLNENNSYRLINCNTSAITQACPKVSFDPIPIHYCAPAGYAILKCNNKTFNGTGPCNNVSTVQCTHGIKPVVSTQLLLNGSLAEEEIIIRSENLTNNAKTIIVHLNESVEIVCTRPNNNTRKSIRIGPGQTFYATGDIIGDIRQAHCNISEDKWNKTLQKVSKKLKEHFPNKTIKFEPSSGGDLEITTHSFNCRGEFFYCNTSKLFNSTYNSTNSTITLPCRIKQIINMWQEVGRAMYAPPIAGNITCKSNITGLLLTRDGGKNNTETFRPGGGDMRDNWRSELYKYKVVEIKPLGIAPTKAKTLTVQARQLLSGIVQQQSNLLRAIEAQQHMLQLTVWGIKQLQTRVLAIERYLKDQQLLGIWGCSGKLICTTAVPWNSSWSNKSQEDIWDNMTWMQWDREISNYTDTIYRLLEDSQNQQEKNEKDLLALDSWKNLWNWFDITNWLW

SEQ ID NO: 43 - DNA, 1888 bp, Human immunodeficiency virus
ttcagtcgacagccaccatgcgagtgagaggcattctgcggaattgtcagcaatggtggatctggggcatactcggattctggatgcttatgatatgcaatgttgtggggaacctgtgggttaccgtatactatggggttccagtctggaaggaggctaaaacaacgctgttctgtgcaagtgacgccaaagcctacgagaaagaagtgcacaacgtctgggctacccacgcttgtgttccaaccgatccaaacccccaggaaatcgtcctcgagaacgtgactgaaaactttaacatgtggaagaatgatatggtagatcagatgcacgaagatatcatttcattgtgggaccaatcattgaaaccatgcgtaaaactgacccccctctgcgtaacacttaactgcaccaatgcaactaatgccaccaatactatgggcgaaataaaaaactgtagctttaacattacaacggaactccgggataagaaacaaaaggtctacgcgctcttttaccgactcgatatcgtcccacttaacgagaataatagttaccgcctgattaactgtaacacatcagccattacgcaagcttgccccaaagtttctttcgaccccatcccaattcactattgtgcccccgctggatacgctatacttaaatgcaacaataaaacatttaatggaaccggaccatgtaacaacgtcagtaccgtacaatgtacgcacggaattaaacctgttgtctcaacccagcttctccttaacggctcattggcggaggaagaaattattatcagatcagaaaacttgaccaacaatgccaaaaccatcatcgtgcacctcaatgaatccgtggaaatcgtgtgcaccagaccaaataacaatacccggaaatcaatcaggattgggcctggccagacattttacgctacaggtgatataattggcgatattagacaagcccattgcaacatatcagaagacaagtggaataagactctgcagaaggtttctaagaagctgaaggaacactttcccaataaaacgattaagttcgagccctcttcaggaggagaccttgagatcacaacacactcttttaattgtagaggggagttcttctattgtaatacatcaaagctctttaacagtacctacaactccactaatagtaccatcacactcccctgcagaataaagcaaataatcaacatgtggcaagaagttggccgagcaatgtacgcccctcccatcgcaggcaacattacatgtaaatccaatattactggccttttgctgacacgggacggcggaaagaataacactgagaccttcagacctggcggaggcgatatgcgcgataattggcggagcgagctctacaagtataaagtcgttgaaatcaagccactgggcatagctcctacgaaagcaaagacactcactgttcaggctagacagctgctctccggcatagtgcaacagcaatccaatctcctgcgagctatcgaagcccaacaacatatgctccagcttaccgtctggggaatcaaacaattgcaaacacgagtgctggcgatagagagatatttgaaagatcagcaactcctggggatttggggctgttcaggtaagctcatctgtacaactgcggtgccgtggaactcaagctggagtaacaaaagccaagaggatatatgggacaacatgacttggatgcagtgggatcgagaaataagcaactatacagataccatttatcggctcctggaggactcacagaaccagcaggagaaaaatgagaaagatttgctcgcgcttgacagttggaagaatttgtggaattggttcgacattacaaactggctctggtaaagatcttacaa

SEQ ID NO: 44 - protein, 842 aa, Human immunodeficiency virus
MRVKGIQRNWQHLWKWGTLILGLVIICSASNNLWVTVYYGVPVWEDADTTLFCASDAKAYSTERHNVWATHACVPTDPNPQEITLENVTENFNMWKNNMVEQMHEDIISLWDESLKPCVKLTPLCVTLNCTDVNVTNNNTNNTKKEIKNCSFNITTEIRDKKKKEYALFYRLDVVPINDNGNSSIYRLINCNVSTIKQACPKVTFDPIPIHYCAPAGFAILKCRDKKFNGTGPCKNVSTVQCTHGIKPVVSTQLLLNGSLAEEEIIIRSENITDNTKVIIVQLNETIEINCTRPNNNTRKSIRIGPGQAFYATGDIIGDIRQAHCNVSRTKWNEMLQKVKAQLKKIFNKSITFNSSSGGDLEITTHSFNCRGEFFYCNTSGLFNNSLLNSTNSTITLPCKIKQIVRMWQRVGQAMYAPPIAGNITCRSNITGLLLTRDGGNNNTETFRPGGGDMRDNWRSELYKYKIVKIKPLGVAPTRARRRVVEREKRAVGLGAVLLGFLGAAGSTMGAASITLTVQVRQLLSGIVQQQSNLLRAIEAQQHLLQLTVWGIKQLQARVLAVERYLKDQQLLGIWGCSGKLICTTNVPWNTSWSNKSYNEIWDNMTWIEWEREISNYTQQIYSLIEESQNQQEKNEQDLLALDKWASLWNWFDITKWLWYIKIFIMIVGGLIGLRIVFAVLSIVNRVRQGYSPLSFQTLTHHQREPDRPERIEEGGGEQDKDRSIRLVSGFLALAWDDLRSLCLFSYHRLRDFILIAARTVELLGRSSLKGLRLGWEGLKYLWNLLLYWGQELKNSAINLLDTIAIAVANWTDRVIEVAQRACRAILNIPRRIRQGLERALL

SEQ ID NO: 45 - protein, 626 aa, Human immunodeficiency virus
MRVKGIQRNWQHLWKWGTLILGLVIICSASNNLWVTVYYGVPVWEDADTTLFCASDAKAYSTERHNVWATHACVPTDPNPQEITLENVTENFNMWKNNMVEQMHEDIISLWDESLKPCVKLTPLCVTLNCTDVNVTNNNTNNTKKEIKNCSFNITTEIRDKKKKEYALFYRLDVVPINDNGNSSIYRLINCNVSTIKQACPKVTFDPIPIHYCAPAGFAILKCRDKKFNGTGPCKNVSTVQCTHGIKPVVSTQLLLNGSLAEEEIIIRSENITDNTKVIIVQLNETIEINCTRPNNNTRKSIRIGPGQAFYATGDIIGDIRQAHCNVSRTKWNEMLQKVKAQLKKIFNKSITFNSSSGGDLEITTHSFNCRGEFFYCNTSGLFNNSLLNSTNSTITLPCKIKQIVRMWQRVGQAMYAPPIAGNITCRSNITGLLLTRDGGNNNTETFRPGGGDMRDNWRSELYKYKIVKIKPLGVAPTRARTLTVQVRQLLSGIVQQQSNLLRAIEAQQHLLQLTVWGIKQLQARVLAVERYLKDQQLLGIWGCSGKLICTTNVPWNTSWSNKSYNEIWDNMTWIEWEREISNYTQQIYSLIEESQNQQEKNEQDLLALDKWASLWNWFDITKWLW

SEQ ID NO: 46 - DNA, 1909 bp, Human immunodeficiency virus
ttcagtcgacagccaccatgcgagtgaagggaatccagagaaattggcagcacctttggaagtggggcacactcatcctcggccttgtgatcatatgctctgcctcaaataacctttgggtcacagtttattacggcgtgcccgtttgggaggacgcagacacaactcttttttgtgccagcgacgctaaggcttattcaacagagaggcataacgtttgggctacacatgcatgcgtgccgaccgatcctaatccccaggaaatcactcttgagaatgttacagagaattttaatatgtggaagaacaacatggttgaacagatgcatgaagacataatttctctctgggatgaatctctgaaaccttgcgtgaagcttacaccactgtgcgttaccctgaattgcactgacgtcaatgtcacaaataataataccaacaatacaaaaaaagaaatcaaaaattgttctttcaacataaccaccgagatacgcgataaaaaaaagaaagaatacgccctgttctacagactcgatgtggtcccaattaatgacaacggaaattcttccatctaccgacttatcaattgtaacgtgtctacaatcaaacaggcctgtcctaaagtcacatttgaccctattcccattcattactgtgcccccgctggcttcgctattcttaaatgccgagacaaaaaatttaacggaacaggaccatgcaagaatgtctcaacagttcaatgcactcatggaattaaaccagtcgtttctactcaactccttctcaatggaagcctggcagaagaggaaatcataatccgcagcgaaaacataaccgacaacacaaaagtaatcatcgtacagctgaacgagaccattgaaataaattgtacgagacctaataataacacaagaaaaagcatacgcatcggccccggacaggctttctacgccacaggagacattatcggagatatccgccaggctcactgtaatgtgtctagaacaaaatggaacgaaatgcttcagaaggtcaaagctcagctcaagaaaatattcaacaaatctattacattcaactcatcatcaggcggcgatctggagataacaactcattccttcaactgtcggggagaatttttttactgtaacacgtccggcctgttcaacaattcactcctgaatagcactaactccaccatcactctcccatgtaagatcaaacaaatcgtcagaatgtggcagcgagtcggtcaagctatgtacgcccctccaatcgccggtaatatcacatgtagaagcaatatcacagggctcttgcttacaagggacggcgggaacaacaacaccgaaaccttcagaccaggaggaggagacatgcgagacaattggcggagcgagctgtataaatataagatcgtaaaaatcaaaccattgggtgtagcgccaactagagcccgaacactgaccgtgcaggtgaggcaactgctgagcggcattgtccaacaacaatccaatcttcttagagcaatcgaggcccagcagcatctgctccagcttactgtatggggaatcaaacaactgcaagcaagagtattggcagtggagaggtatctcaaggaccagcagcttctgggaatttggggttgcagcggaaagctcatatgtacaaccaatgtgccctggaacactagttggagtaataagagttacaatgaaatctgggacaatatgacatggatcgaatgggagcgcgaaatatccaactatactcagcaaatctattccctcattgaagagagtcagaaccagcaggaaaagaatgagcaagacctcctcgccctggataaatgggcatctctgtggaactggtttgacataactaaatggttgtggtaaagatcttacaa

SEQ ID NO: 47 - protein, 854 aa, Human immunodeficiency virus
MRVKETQMNWPNLWKWGTLILGLVIICSASDNLWVTVYYGVPVWRDADTTLFCASDAKAHETEVHNVWATHACVPTDPNPQEIHLENVTENFNMWKNNMVEQMQEDVISLWDQSLKPCVKLTPLCVTLNCTNANLTNVNNITNVSNIIGNITNEVRNCSFNMTTELRDKKQKVHALFYKLDIVQIEDNNSYRLINCNTSVIKQACPKISFDPIPIHYCTPAGYAILKCNDKNFNGTGPCKNVSSVQCTHGIKPVVSTQLLLNGSLAEEEIIIRSENLTNNAKTIIVHLNKSVEINCTRPSNNTRTSITIGPGQVFYRTGDIIGDIRKAYCEINGTKWNEVLKQVTEKLKEHFNNKTIIFQPPSGGDLEITMHHFNCRGEFFYCNTTKLFNNTCIGNETMEGCNGTIILPCKIKQIINMWQGAGQAMYAPPISGRINCVSNITGILLTRDGGANNTNETFRPGGGNIKDNWRSELYKYKVVQIEPLGIAPTRAKRRVVEREKRAVGIGAMIFGFLGAAGSTMGAASITLTVQARQLLSGIVQQQSNLLRAIEAQQHLLQLTVWGIKQLQARVLAVERYLKDQKFLGLWGCSGKIICTTAVPWNSTWSNRSFEEIWNNMTWIEWEREISNYTNQIYEILTESQNQQDRNEKDLLELDKWASLWNWFDITNWLWYIKIFIMIVGGLIGLRIIFAVLSIVNRVRQGYSPLSFQTPTHHQREPDRPERIEEGGGEQGRDRSVRLVSGFLALAWDDLRSLCLFSYHRLRDFILIAARTVELLGHSSLKGLRRGWEGLKYLGNLLLYWGQELKISAISLLDATAIAVAGWTDRVIEVAQGAWRAILHIPRRIRQGLERALL

SEQ ID NO: 48 - protein, 638 aa, Human immunodeficiency virus
MRVKETQMNWPNLWKWGTLILGLVIICSASDNLWVTVYYGVPVWRDADTTLFCASDAKAHETEVHNVWATHACVPTDPNPQEIHLENVTENFNMWKNNMVEQMQEDVISLWDQSLKPCVKLTPLCVTLNCTNANLTNVNNITNVSNIIGNITNEVRNCSFNMTTELRDKKQKVHALFYKLDIVQIEDNNSYRLINCNTSVIKQACPKISFDPIPIHYCTPAGYAILKCNDKNFNGTGPCKNVSSVQCTHGIKPVVSTQLLLNGSLAEEEIIIRSENLTNNAKTIIVHLNKSVEINCTRPSNNTRTSITIGPGQVFYRTGDIIGDIRKAYCEINGTKWNEVLKQVTEKLKEHFNNKTIIFQPPSGGDLEITMHHFNCRGEFFYCNTTKLFNNTCIGNETMEGCNGTIILPCKIKQIINMWQGAGQAMYAPPISGRINCVSNITGILLTRDGGANNTNETFRPGGGNIKDNWRSELYKYKVVQIEPLGIAPTRAKTLTVQARQLLSGIVQQQSNLLRAIEAQQHLLQLTVWGIKQLQARVLAVERYLKDQKFLGLWGCSGKIICTTAVPWNSTWSNRSFEEIWNNMTWIEWEREISNYTNQIYEILTESQNQQDRNEKDLLELDKWASLWNWFDITNWLW

SEQ ID NO: 49 - DNA, 1945 bp, Human immunodeficiency virus
ttcagtcgacagccaccatgcgagtcaaggaaacacaaatgaactggcctaatctgtggaagtggggcaccctgatcctgggtttggtcattatttgctctgcgagcgacaatctctgggttactgtctattacggagtccccgtttggagagatgccgacactacactgttctgcgcctcagatgccaaagctcatgaaactgaagtgcataatgtttgggcaacccacgcctgtgttcctaccgacccaaacccccaagaaatacacctggaaaacgtgaccgagaactttaatatgtggaagaataacatggttgaacagatgcaagaagacgtaatcagcctgtgggatcaaagtctgaaaccttgcgtaaaactgactccactttgcgtaacacttaattgcaccaacgcgaacctgacaaacgttaacaacatcactaacgtctccaacatcatcggcaacataacgaacgaagtgagaaattgcagtttcaatatgactacagagctccgggacaagaaacagaaggtccatgctctcttttacaaactcgacatcgtccagatcgaagacaataacagctacagacttataaattgtaatacatccgtgattaaacaagcatgccccaaaataagcttcgatcctattcctatccactactgtactcctgccggctatgctatcttgaaatgcaatgataagaacttcaatgggaccggaccttgtaagaacgtgtctagtgtgcaatgcactcacggcattaaaccagtggtaagcacccagctgctcctgaacggctctctggcagaggaagagattattattcgaagtgagaacctcaccaacaacgctaagactatcatcgtacatctcaataaatcagtcgaaattaattgcaccagaccctccaataatactagaacttcaatcactatcggcccaggacaagtcttttatagaacaggagatatcataggagatatcagaaaggcatattgcgagataaacgggacaaaatggaacgaagtactcaaacaagtcacagagaagcttaaggaacatttcaacaataaaaccattatttttcaacccccaagtggcggagacctcgaaatcactatgcaccacttcaactgccgcggcgaatttttttattgcaataccactaaacttttcaacaatacgtgcatcggaaatgagaccatggagggctgcaatggaacaatcatactcccatgcaagataaaacaaatcattaacatgtggcaaggtgctggacaagctatgtatgcacccccaatatccggtagaattaattgcgtcagcaacatcactggcatactgctcactagagacggaggagcaaataatacaaatgaaacattccgaccaggcggcggcaacattaaggacaactggcggtccgaactctataagtacaaagtcgtacagatcgaacctcttggaatagcaccgactcgcgctaagacactcacagtacaggcccgacaacttctttctggaatcgtacagcagcaatccaacctcctccgcgcaatcgaggcccaacaacatctgcttcagctcacagtttggggaatcaagcagctccaggcacgcgtgctcgcagtggaaagatacctgaaggatcagaaattccttggtctctggggatgttctggcaaaataatctgcactaccgcggttccctggaattcaacatggagcaaccggagttttgaagagatatggaacaatatgacatggatagagtgggaaagggaaattagtaactatacgaaccagatatacgaaatcctcaccgaaagccaaaatcagcaggatcgcaacgaaaaagacctcctcgagcttgataagtgggcatccctttggaactggttcgacatcacaaattggctctggtaaagatcttacaa

SEQ ID NO: 50 - protein, 863 aa, Human immunodeficiency virus
MGAMGIQMNWQNLWRWGTMILGMLIICSVAEKSWVTVYYGVPVWRDAETTLFCASDAKAHDKEVHNVWATHACVPTDPNPQEMILENVTEDFNMWKNSMVEQMHTDIISLWDQSLKPCVKLTPLCVTLNCSDSNITSNSTSNSTKDSATLDMKSEIQNCSFNMTTELRDKKQKVYSLFYRLDVVQINENSSDYRLINCNTSAITQACPKVTFEPIPIHYCAPAGFAILKCNDKKFNGTGPCTNVSTVQCTHGIKPVVTTQLLLNGSLAEEEVMIRSENITENAKNIIVQFKEPVQIICIRPGNNTRKSVHIGPGQAFYATGDIIGDIRQAHCNVSRELWNKTLQEVATQLRKHFRNNTKIIFTNSSGGDVEITTHSFNCGGEFFYCDTSGLFNSSWTASNDSMQEAHSTESNITLQCRIKQIINMWQRAGQAMYAPPIPGIIRCESNITGLILTRDGGEGNNSTNETFRPVGGNMRDNWRSELYKYKVVKVEPLGVAPTKSRRRVVEREKRAVGLGAVFIGFLGAAGSTMGAASMTLTVQARQLLSGIVQQQSNLLRAIEAQQHLLKLTVWGIKQLQARVLAVERYLRDQQLLGIWGCSGKLICTTNVPWNSSWSNKSLDEIWENMTWMQWDKEVSNYTQMIYNLLEESQNQQEKNEQELLALDKWANLWNWFNISNWLWYIKIFIMIVGGLIGLRIVFAVLSVINRVRQGYSPLSFQTHTPNPRGLDRPGRIEEEGGEQDRDRSIRLVSGFLALAWDDLRSLCLFSYHRLRDFILIAARTLELLGHNSLKGLRLGWEGLKYLWNLLAYWGRELKISAISLVDSIAIAVAGWTDRIIEIVQAIGRAILHIPRRIRQGLERALI

SEQ ID NO: 51 - protein, 647 aa, Human immunodeficiency virus
MGAMGIQMNWQNLWRWGTMILGMLIICSVAEKSWVTVYYGVPVWRDAETTLFCASDAKAHDKEVHNVWATHACVPTDPNPQEMILENVTEDFNMWKNSMVEQMHTDIISLWDQSLKPCVKLTPLCVTLNCSDSNITSNSTSNSTKDSATLDMKSEIQNCSFNMTTELRDKKQKVYSLFYRLDVVQINENSSDYRLINCNTSAITQACPKVTFEPIPIHYCAPAGFAILKCNDKKFNGTGPCTNVSTVQCTHGIKPVVTTQLLLNGSLAEEEVMIRSENITENAKNIIVQFKEPVQIICIRPGNNTRKSVHIGPGQAFYATGDIIGDIRQAHCNVSRELWNKTLQEVATQLRKHFRNNTKIIFTNSSGGDVEITTHSFNCGGEFFYCDTSGLFNSSWTASNDSMQEAHSTESNITLQCRIKQIINMWQRAGQAMYAPPIPGIIRCESNITGLILTRDGGEGNNSTNETFRPVGGNMRDNWRSELYKYKVVKVEPLGVAPTKSRTLTVQARQLLSGIVQQQSNLLRAIEAQQHLLKLTVWGIKQLQARVLAVERYLRDQQLLGIWGCSGKLICTTNVPWNSSWSNKSLDEIWENMTWMQWDKEVSNYTQMIYNLLEESQNQQEKNEQELLALDKWANLWNWFNISNWLW

SEQ ID NO: 52 - DNA, 1972 bp, Human immunodeficiency virus
ttcagtcgacagccaccatgggggcaatgggaatccagatgaactggcagaacctctggcgatggggcacaatgatcctgggtatgctcatcatctgctctgttgcagaaaagtcatgggtaacagtctactacggcgtaccagtgtggcgggacgccgaaaccactctcttctgcgcctccgatgccaaagcacacgataaagaagtccacaatgtttgggctacccatgcgtgcgtgccaaccgatcctaacccacaagaaatgatactcgaaaacgttactgaagacttcaacatgtggaaaaattctatggttgaacagatgcacaccgacataatatcactgtgggatcagtctctcaaaccctgtgtcaaattgacccccctctgcgttacactgaactgttccgactcaaatatcacttctaattcaacgagcaatagtacgaaagactccgcaacccttgatatgaaaagcgaaatacagaactgttcatttaatatgaccaccgaactgagagataaaaagcagaaggtttattctctgttctatcgattggacgtggttcagattaacgaaaatagcagcgattaccgactcattaactgcaatacatcagcaatcacacaggcttgcccaaaggtaacatttgagccaatccctattcactactgcgcccctgcaggatttgccatcctgaaatgcaacgataagaagtttaatgggacaggaccctgcaccaacgtctccaccgtgcaatgcacccacggcataaaacctgttgttaccacacaattgctgctcaatggatcacttgctgaagaggaagtcatgattcggtctgaaaacatcactgaaaatgccaaaaatattatagttcagttcaaagaacccgtccagatcatttgcattcgccctggtaacaacactcgcaagtcagtgcacattgggcccggccaggctttctatgcaaccggagatattataggcgacatcagacaggcacattgcaacgtcagccgggaattgtggaacaaaactttgcaggaagttgctactcagctgcgaaaacatttcagaaacaatacaaagattattttcactaattcatcaggcggtgacgtggagatcactacccattcatttaactgtggcggagaattcttctattgcgatacctctgggctctttaattcctcatggactgctagcaacgattcaatgcaagaagcacattccacagaaagtaatatcacactgcagtgccgaattaaacaaatcatcaatatgtggcagcgggccggtcaagcaatgtacgcacctcccatccccggaattattcgatgtgagtctaatatcactggcctcattctgacccgagacggtggcgaaggtaataattctacaaacgagactttcagacccgtaggaggcaatatgcgagacaattggcgatccgaactgtataaatataaagtggtgaaggtagaacctcttggagtggcacccaccaaatcacgaaccctgactgtgcaggcacgccaacttctgagcggaatagtccaacagcaatccaatcttctgagagctatagaagcccagcaacacctgcttaaacttacggtgtggggaatcaaacaattgcaggcaagagtgctggcagtggaacgatacttgagagaccaacaactcctgggaatctggggatgttccggtaagttgatttgcacgacaaacgttccctggaactcttcctggtcaaacaagagtctggacgaaatatgggaaaatatgacatggatgcagtgggacaaggaagttagcaactatacacagatgatctacaacctcctcgaagaatctcagaatcaacaggaaaaaaacgaacaagaactgctcgccctcgataagtgggctaacctctggaactggtttaatatttcaaactggttgtggtaaagatcttacaa

SEQ ID NO: 53 - protein, 861 aa, Human immunodeficiency virus
MRVKEIRRNCQRLRRWGTMLLGMLMICSATEQLWVTVYYGVPVWKEATTTLFCASDAKAYVTEKHNVWATHACVPTDPNPQEVVLENVTENFNMWKNNMVEQMHEDIISLWEQSLKPCVKLTPLCVTLNCTDKLRNDTSGTNSSSWEKVQKGEIKNCSFNITTGIRGRVQEYSLFYKLDVIPIDSRNNSNNSTEFSSYRLISCNTSVITQACPKISFEPIPIHYCAPAGFAILKCNDKKFNGTGPCKNVSTVQCTHGIKPVVSTQLLLNGSLAEEEVVIRSENFTNNVKSIIVQLNKSVVINCTRPNNNTRKSIHIGAGKALYTGEIIGDIRQAHCNLSRAQWNNTLKQIVIKLREQFGNKTIVFNQSSGGDVEIVMHSFNCGGEFFYCNSTQLFNSTWNGNDTWNDTWKDTTNDNITLPCRIKQIVNMWQKVGKAMYAPPIRGQIRCSSKITGLILTRDGGTNGTNETETFRPGGGNMKDNWRSELYKYKVVKIEPLGIAPTKAKRRVVQREKRAVGTIGAMFLGFLGAAGSTMGAASLTLTVQARLLLSGIVQQQNNLLRAIEAQQHLLQLTVWGIKQLQARVLAVERYLRDQQLLGIWGCSGRLICTTNVPWNTSWSNRSLNYIWDNMTWMQWDREINNYTDYIYTLLEDAQNQQEKNEQELLELDKWASLWNWFDITNWLWYIKIFIMIVGGLIGLRIVFAVLSIVNRVRQGYSPLSLQTHLPARRGPDRPEGIGEEGGERDRDRSVRLVHGFLALVWEDLRSLCLFSYHRLRDLLLIVARTVEILGQRGWEALKYWWNLLLYWSLELKNSAVSLVDTIAIAVAEGTDRIIEIARRIFRAFLHIPTRIRQGLERALL

SEQ ID NO: 54 - protein, 651 aa, Human immunodeficiency virus
MRVKEIRRNCQRLRRWGTMLLGMLMICSATEQLWVTVYYGVPVWKEATTTLFCASDAKAYVTEKHNVWATHACVPTDPNPQEVVLENVTENFNMWKNNMVEQMHEDIISLWEQSLKPCVKLTPLCVTLNCTDKLRNDTSGTNSSSWEKVQKGEIKNCSFNITTGIRGRVQEYSLFYKLDVIPIDSRNNSNNSTEFSSYRLISCNTSVITQACPKISFEPIPIHYCAPAGFAILKCNDKKFNGTGPCKNVSTVQCTHGIKPVVSTQLLLNGSLAEEEVVIRSENFTNNVKSIIVQLNKSVVINCTRPNNNTRKSIHIGAGKALYTGEIIGDIRQAHCNLSRAQWNNTLKQIVIKLREQFGNKTIVFNQSSGGDVEIVMHSFNCGGEFFYCNSTQLFNSTWNGNDTWNDTWKDTTNDNITLPCRIKQIVNMWQKVGKAMYAPPIRGQIRCSSKITGLILTRDGGTNGTNETETFRPGGGNMKDNWRSELYKYKVVKIEPLGIAPTKAKTLTVQARLLLSGIVQQQNNLLRAIEAQQHLLQLTVWGIKQLQARVLAVERYLRDQQLLGIWGCSGRLICTTNVPWNTSWSNRSLNYIWDNMTWMQWDREINNYTDYIYTLLEDAQNQQEKNEQELLELDKWASLWNWFDITNWLW

SEQ ID NO: 55 - DNA, 1984 bp, Human immunodeficiency virus
ttcagtcgacagccaccatgagagtaaaagaaatcagacgcaactgtcagaggttgaggagatggggaacgatgctcctgggcatgctgatgatttgcagtgccaccgaacagctttgggtaaccgtgtactatggtgtacctgtatggaaagaagccactacaaccctgttttgcgcgtccgacgcaaaagcctacgtaacagaaaagcacaacgtgtgggccacacatgcatgcgtgccaacagatccaaatcctcaggaagtcgttctggaaaatgtaacagaaaattttaatatgtggaaaaacaatatggtagagcagatgcatgaagatatcatctcactgtgggaacaatccttgaaaccttgtgtcaaactgaccccactttgcgtaacacttaactgtactgataagcttcgcaatgatacgtccggaacaaattcaagcagctgggaaaaagtgcaaaagggcgaaatcaaaaattgttcatttaacatcactaccggtatcagagggcgggtacaggaatattctcttttctacaaactcgacgtcatcccaatcgactccagaaataactcaaataatagcacagaatttagtagttatcgccttataagctgcaacaccagcgtgattacacaagcgtgccctaaaatctcttttgagcccattcctattcactactgcgcaccagccggcttcgccatcctcaaatgtaacgacaagaaatttaacggaaccggaccctgtaagaatgtgtccaccgttcaatgcactcatggaatcaagcccgtcgtttctacccaacttcttctcaatggtagccttgcggaggaggaagttgtgattcgctccgaaaattttacaaacaacgtcaagtcaatcatcgtccagcttaataaatccgtcgttattaattgtacaagacccaacaataacaccagaaaatccattcacataggggccgggaaagctctgtataccggggaaattattggagacatcagacaagcacactgtaacttgagtcgcgcccagtggaacaacacattgaaacagatcgtgatcaagctcagagagcagttcgggaataagactatcgtgtttaatcagagctccggcggtgatgtcgaaatcgtaatgcactcttttaattgtgggggtgaatttttttactgcaattctacacaattgtttaacagcacctggaacggcaatgacacatggaatgacacctggaaagatacgacaaatgataatattactcttccgtgcagaataaagcaaatcgtaaatatgtggcaaaaagtgggcaaggccatgtacgcaccacctataagaggacaaattcgctgttcttccaagatcacaggtctgatactcacacgggacggaggcacgaacgggacaaacgagaccgagaccttccgaccaggaggcggcaacatgaaggataactggagaagtgaactttacaagtataaagtggtcaagattgagcctctgggtatcgcccctactaaggctaaaacactcaccgtgcaggctagattgctgctttcagggatagtccaacaacagaacaaccttcttagagccattgaagcacaacaacacttgctgcagttgacagtgtggggaattaaacagttgcaggcccgggttctcgctgtcgaacggtatcttagagatcagcagcttttgggtatctgggggtgttcaggccgcctcatatgcaccacaaatgtcccttggaatacctcatggagtaacaggtctcttaattatatttgggacaatatgacatggatgcaatgggatagagaaattaataactacaccgactacatctacacacttctggaggacgcccagaatcagcaggagaagaacgagcaggaactcctcgaattggataagtgggcatcactgtggaattggttcgatataactaattggctttggtaaagatcttacaa

SEQ ID NO: 56 - protein, 854 aa, Human immunodeficiency virus
MRVKGIQRNWPQWWIWGILGFWMIIICRVVGNLWVTVYYGVPVWTEAKTTLFCASDAKAYEREVHNVWATHACVPTDPNPQEIVLGNVTENFNMWKNDMVDQMHEDIISIWDQSLKPCVKLTPLCVTLNCTDVKVNATSNGTTTYNNSIDSMNGEIKNCSFNITTEIRDKKQKVYALFYRPDVVPLNENSSSYILINCNTSTTTQACPKVSFDPIPIHYCAPAGYAILKCNNKTFNGTGPCHNVSTVQCTHGIKPVVSTQLLLNGSLAEEEIIIRSENLTNNAKTIIVHLNESIEIVCTRPNNNTRKSIRIGPGQTVYATNDIIGDIRQAHCNISKTKWNTTLEKVKEKLKEHFPSKAITFQPHSGGDLEVTTHSFNCRGEFFYCDTTKLFNESNLNTTNTTTLTLPCRIKQIVNMWQGVGRAMYAPPVEGNITCNSSITGLLLVRDGGNTSNSTPEIFRPGGGNMKDNWRSELYKYKVVEIKPLGVAPTKAKRRVVEREKRAVGIGAVLFGFLGAAGSTMGAASITLTVQARQLLSGIVQQQSNLLRAIEAQQHMLQLTVWGIKQLQARVLAIERYLKDQQLLGLWGCSGKLICPTTVPWNSSWSNKSQTDIWDNMTWMQWDREISNYTGTIYKLLEESQNQQEKNEKDLLALDSWKNLWSWFDITNWLWYIKIFIMIVGGLIGLRIIFGVLSIVKRVRQGYSPLSFQTLTPNPRGLDRLGRIEEEGGEQDKDRSIRLVNGFLALAWDDLRSLCLFSYHRLRDFILVAARAVELLGRSSLRGLQRGWEALKYLGNLVQYGGLELKRRAISLFDTIAIAVAEGTDRILEVILRIIRAIRNIPTRIRQGFEAALL

SEQ ID NO: 57 - protein, 638 aa, Human immunodeficiency virus
MRVKGIQRNWPQWWIWGILGFWMIIICRVVGNLWVTVYYGVPVWTEAKTTLFCASDAKAYEREVHNVWATHACVPTDPNPQEIVLGNVTENFNMWKNDMVDQMHEDIISIWDQSLKPCVKLTPLCVTLNCTDVKVNATSNGTTTYNNSIDSMNGEIKNCSFNITTEIRDKKQKVYALFYRPDVVPLNENSSSYILINCNTSTTTQACPKVSFDPIPIHYCAPAGYAILKCNNKTFNGTGPCHNVSTVQCTHGIKPVVSTQLLLNGSLAEEEIIIRSENLTNNAKTIIVHLNESIEIVCTRPNNNTRKSIRIGPGQTVYATNDIIGDIRQAHCNISKTKWNTTLEKVKEKLKEHFPSKAITFQPHSGGDLEVTTHSFNCRGEFFYCDTTKLFNESNLNTTNTTTLTLPCRIKQIVNMWQGVGRAMYAPPVEGNITCNSSITGLLLVRDGGNTSNSTPEIFRPGGGNMKDNWRSELYKYKVVEIKPLGVAPTKAKTLTVQARQLLSGIVQQQSNLLRAIEAQQHMLQLTVWGIKQLQARVLAIERYLKDQQLLGLWGCSGKLICPTTVPWNSSWSNKSQTDIWDNMTWMQWDREISNYTGTIYKLLEESQNQQEKNEKDLLALDSWKNLWSWFDITNWLW

SEQ ID NO: 58 - DNA, 1945 bp, Human immunodeficiency virus
ttcagtcgacagccaccatgcgcgtaaaggggattcaaagaaattggccgcaatggtggatttggggaattctgggcttttggatgataattatatgccgcgttgtcggaaatttgtgggtgactgtgtactacggggtgcccgtgtggactgaggcaaagaccaccctgttctgtgctagcgatgccaaagcctatgaacgcgaagtgcacaatgtttgggctactcatgcctgtgtccctaccgacccaaaccctcaggaaatagtgctcggcaatgtaacggaaaacttcaacatgtggaaaaatgatatggtggatcagatgcacgaagacattatctcaatctgggaccaaagcctgaaaccctgcgttaaactgactcctctctgcgtcactctcaattgcacagatgtcaaagtgaatgccacctcaaacggtacgacaacttacaacaattctattgactctatgaacggcgaaatcaaaaattgttcctttaacatcaccaccgagatacgcgacaaaaagcagaaggtctatgcccttttttaccgccccgacgtagtcccactcaacgagaattccagctcatacatcctcatcaactgcaatacatcaactaccacacaagcatgcccgaaagttagctttgatccaattcctatacattactgcgcccccgccggctacgctatactgaaatgcaataataagacttttaacgggaccggcccatgtcacaacgtgtcaaccgtgcaatgcactcatggcatcaagcccgtggtgtcaacccagctgctgctcaatggctcacttgcagaagaagaaattattatccgctctgagaatcttactaacaatgcaaaaacgattatcgtgcaccttaatgaatcaatagaaatcgtgtgtactcggcccaacaataatactagaaaaagcattcgcatcggacctggccagacagtttacgcaactaatgacatcatcggggacatccgacaggcccattgcaacatttctaaaaccaagtggaatacaaccctggaaaaagtaaaggaaaaacttaaagaacattttccctctaaggcgatcacgtttcaacctcacagtggcggagacttggaagtcacaacacattcttttaactgccgcggagaatttttttattgtgatacaacaaaactttttaatgaatcaaatctcaacaccacaaatacaaccacactgaccctcccctgtagaatcaaacaaatcgtaaacatgtggcaaggggttggaagggctatgtacgctccccccgtcgaaggaaatataacgtgtaacagcagcatcactgggctgcttcttgttcgagacggaggcaatacttctaattcaactcctgaaatttttaggcctggcggtggcaatatgaaagataactggcgctcagaactgtacaaatacaaagttgttgaaattaagcccctgggagtcgctccaaccaaagctaaaacactcacagtgcaagcaagacagctcctttcaggcatcgtccagcaacagtcaaatctccttagagcaatcgaagcccaacagcatatgctccaactcacagtctgggggattaaacagcttcaagcccgcgtgcttgctatcgaacgctatcttaaagaccaacagcttcttggcctctggggttgtagtggaaaactcatctgccccaccaccgtgccttggaatagttcttggagtaataaatcacagaccgatatttgggacaacatgacctggatgcaatgggatagggaaatttctaattatactggcacaatctacaaactcttggaagaaagtcaaaatcagcaagaaaaaaacgaaaaggacctcctcgccctggactcctggaagaatctttggagctggttcgacataactaattggctgtggtaaagatcttacaa

SEQ ID NO: 59 - protein, 854 aa, Human immunodeficiency virus
MRVKETQMNWPNLWKWGTLILGLVIICSASDNLWVTVYYGVPVWRDADTTLFCASDAKAHETEVHNVWATHACVPTDPNPQEIHLENVTENFNMWRNNMVEQMQEDVISLWDQSLKPCVKLTPLCVTLNCTNANWTNSNNTTNGPNKIGNITDEVKNCTFNMTTELKDKKQKVHALFYKLDIVQINSSEYRLINCNTSVIKQACPKISFDPIPIHYCTPAGYAILKCNDKNFNGTGPCKNVSSVQCTHGIKPVVSTQLLLNGSLAEEEIIIRSENLTNNAKTIIVHLNKSVEINCTRPSNNTRTSITMGPGQVFYRTGDIIGDIRKAYCEINGIKWNEVLVQVTGKLKEHFNKTIIFQPPSGGDLEIITHHFSCRGEFFYCNTTKLFNNTCIGNTSMEGCNNTIILPCKIKQIINMWQGVGQAMYAPPISGRINCVSNITGILLTRDGGADNNTTNETFRPGGGNIKDNWRSELYKYKVVEIEPLGIAPTRAKRRVVEREKRAVGIGAMIFGFLGAAGSTMGAASITLTVQARQLLSGIVQQQSNLLRAIEAQQHLLQLTVWGIKQLQARVLAVERYLKDQKFLGLWGCSGKIICTTAVPWNSSWSNKSFEEIWDNMTWIEWEREISNYTSQIYEILTESQNQQDRNEKDLLELDKWASLWNWFDITNWLWYIKIFIIIVGSLIGLRIIFAVLSIVNRVRQGYSPLSFQTPTHHQREPDRPEEIGEGGGEQSKDRSVRLVSGFLALAWDDLRSLCLFSYHLLRDFILIAARTVELLGHSSLKGLRRGWEGLKYLGNLLLYWGQEIKISAISLLNATAIAVAGWTDRVIEVAQRAWRALLHIPRRIRQGLERALL

SEQ ID NO: 60 - protein, 630 aa, Human immunodeficiency virus
MRVKETQMNWPNLWKWGTLILGLVIICSASDNLWVTVYYGVPVWRDADTTLFCASDAKAHETEVHNVWATHACVPTDPNPQEIHLENVTENFNMWRNNMVEQMQEDVISLWDQSLKPCVKLTPLCVTLNCTNANWTNSNNTTNGPNKIGNITDEVKNCTFNMTTELKDKKQKVHALFYKLDIVQINSSEYRLINCNTSVIKQACPKISFDPIPIHYCTPAGYAILKCNDKNFNGTGPCKNVSSVQCTHGIKPVVSTQLLLNGSLAEEEIIIRSENLTNNAKTIIVHLNKSVEINCTRPSNNTRTSITMGPGQVFYRTGDIIGDIRKAYCEINGIKWNEVLVQVTGKLKEHFNKTIIFQPPSGGDLEIITHHFSCRGEFFYCNTTKLFNNTCIGNTSMEGCNNTIILPCKIKQIINMWQGVGQAMYAPPISGRINCVSNITGILLTRDGGADNNTTNETFRPGGGNIKDNWRSELYKYKVVEIEPLGIAPTRARTLTVQARQLLSGIVQQQSNLLRAIEAQQHLLQLTVWGIKQLQARVLAVERYLKDQKFLGLWGCSGKIICTTAVPWNSSWSNKSFEEIWDNMTWIEWEREISNYTSQIYEILTESQNQQDRNEKDLLELDKWASLWNW

SEQ ID NO: 61 - DNA, 1921 bp, Human immunodeficiency virus
ttcagtcgacagccaccatgcgagtaaaagagacacaaatgaattggcccaatttgtggaagtggggaacattgatcctgggactggtgataatctgtagtgcatccgacaatctctgggtgaccgtttactatggtgtaccagtttggagagacgctgataccaccctcttctgtgcaagcgacgccaaagcccacgaaactgaagtccataatgtatgggccacccacgcgtgcgtaccaaccgaccctaatccccaagagatccaccttgagaatgtaactgagaattttaacatgtggagaaataacatggtggaacaaatgcaggaagacgttatttccttgtgggaccagagccttaaaccttgtgtcaaattgactcccctgtgtgtgactctcaattgtacaaacgcaaattggaccaacagcaacaacactaccaacggccctaacaaaattggcaatattactgatgaagtcaagaactgcacttttaacatgacaacagaactgaaggataagaaacagaaagtccatgctctgttctataagctcgacatagtacaaattaatagctcagaatatagactgataaactgcaatacttccgttatcaaacaggcctgtccaaagataagcttcgatcccatccctattcactactgcacaccagccggttacgctatcctgaaatgcaacgataagaattttaacggcacaggtccctgcaaaaacgtttcctctgtccagtgtacacacggtatcaagcctgtagtatcaacacaactgctcctgaatggctccttggccgaagaagagatcatcattagaagtgagaacctgacgaacaacgccaagactataatagtgcacctcaataaatctgtagaaatcaactgtacccgaccctcaaacaacactcgaacaagtataacaatgggccctggccaagttttttaccggaccggcgacataataggcgatatcagaaaggcatattgcgagatcaatggcatcaagtggaacgaagtactggttcaagtaactggaaaactcaaagaacattttaataagaccataatattccagcccccgagtggcggcgacctcgagattatcacccatcacttttcttgtagaggcgaatttttttactgtaacacgaccaagctcttcaataacacgtgcatcgggaacacttctatggaaggatgtaataataccattatactgccctgtaagatcaagcagattatcaacatgtggcagggagtaggtcaggcaatgtacgcaccaccgatttcaggacggatcaattgcgtatcaaatatcaccggcattctgctgacccgggacggaggcgcagacaacaataccactaacgagacatttagacctggaggcggcaatataaaggataattggagaagtgagctgtataaatacaaagtcgtagagatcgaacccctcggcattgctccaacccgggcccggactctcaccgtacaagctagacagctgctttctggcatagtccaacagcagtcaaacctcctccgcgctattgaagcacaacaacacctgctccagctgactgtgtggggaatcaaacaattgcaagcaagagtgctcgccgtggaacgctatttgaaagatcagaaatttcttggactttggggctgcagcggcaaaattatttgtacaacagcggtgccttggaactcatcctggagtaataaaagctttgaagaaatctgggacaatatgacatggattgagtgggagagagagatttcaaactatacaagccaaatttacgaaatactgacagaaagtcaaaaccagcaggacagaaatgagaaagacctgctcgaactggataagtgggcctctttgtggaactggtaaagatcttacaa

SEQ ID NO: 62 - protein, 854 aa, Human immunodeficiency virus
MRVKGIQRNWQHLWNWGILILGLVIICSAEKLWVTVYYGVPVWEDANAPLFCASDAKAHSTESHNIWATHACVPTDPSPQEINMRNVTENFNMWKNNMVEQMHEDIISLWDESLKPCVKLTPLCVTLNCTEINNNSTRNITEEYRMTNCSFNMTTELRDKKKAEYALFYRTDVVPINEMNNENNGTNSTWYRLTNCNVSTIKQACPKVTFEPIPIHYCAPAGFAILKCVDKKFNGTGTCNNVSTVQCTHGIKPVVSTQLLLNGSLAEKDIIISSENISDNAKVIIVHLNRSVEINCTRPNNNTRRSVAIGPGQAFYTTGEVIGDIRKAHCNVSWTKWNETLRDVQAKLQEYFINKSIEFNSSSGGDLEITTHSFNCGGEFFYCNTSGLFNNSILKSNISENNDTITLNCKIKQIVRMWQRVGQAMYAPPIAGNITCRSNITGLILTRDGGDNNSTSEIFRPGGGDMKNNWRSELYKYKTVKIKSLGIAPTRARRRVVEREKRAVGVGAIFLGFLGTAGSTMGAASITLTVQVRQLLSGIVQQQSNLLRAIEAQQHLLQLTVWGIKQLRARVLALERYLKDQQLLGIWGCSGKLICTTNVPWNTSWSNKSYNEIWENMTWIEWEREIDNYTYHIYSLIEQSQIQQEKNEQDLLALDQWASLWSWFSISNWLWYIRIFVMIVGGLIGLRIVFAVLSIVNRVRQGYSPLSFQTLLHHQREPDRPAGIEEGGGEQDRDRSIRLVSGFLALAWDDLRSLCLFSYHRLRDFILIAARTVELLGRNSLKGLRLGWEALKYLWNLLLYWARELKNSAINLLDTIAIAVANWTDRVIEVAQRAGRAVLNIPRRIRQGLERALL

SEQ ID NO: 63 - protein, 630 aa, Human immunodeficiency virus
MRVKGIQRNWQHLWNWGILILGLVIICSAEKLWVTVYYGVPVWEDANAPLFCASDAKAHSTESHNIWATHACVPTDPSPQEINMRNVTENFNMWKNNMVEQMHEDIISLWDESLKPCVKLTPLCVTLNCTEINNNSTRNITEEYRMTNCSFNMTTELRDKKKAEYALFYRTDVVPINEMNNENNGTNSTWYRLTNCNVSTIKQACPKVTFEPIPIHYCAPAGFAILKCVDKKFNGTGTCNNVSTVQCTHGIKPVVSTQLLLNGSLAEKDIIISSENISDNAKVIIVHLNRSVEINCTRPNNNTRRSVAIGPGQAFYTTGEVIGDIRKAHCNVSWTKWNETLRDVQAKLQEYFINKSIEFNSSSGGDLEITTHSFNCGGEFFYCNTSGLFNNSILKSNISENNDTITLNCKIKQIVRMWQRVGQAMYAPPIAGNITCRSNITGLILTRDGGDNNSTSEIFRPGGGDMKNNWRSELYKYKTVKIKSLGIAPTRARTLTVQVRQLLSGIVQQQSNLLRAIEAQQHLLQLTVWGIKQLRARVLALERYLKDQQLLGIWGCSGKLICTTNVPWNTSWSNKSYNEIWENMTWIEWEREIDNYTYHIYSLIEQSQIQQEKNEQDLLALDQWASLWSW

SEQ ID NO: 64 - DNA, 1921 bp, Human immunodeficiency virus
ttcagtcgacagccaccatgagagttaaaggaatccaacgcaattggcaacacctttggaactggggcatattgattcttggactggtgataatttgtagcgctgaaaaactctgggtaactgtctattacggcgtgcctgtctgggaggatgccaacgcccccctgttctgcgcaagtgatgcaaaggctcacagcactgaatctcacaacatttgggccacccacgcctgtgtgccaaccgaccctagtcctcaggagatcaacatgagaaacgttaccgaaaattttaatatgtggaagaataatatggtggagcaaatgcacgaagacataatttcactctgggacgagtctctgaaaccatgtgtgaaacttacccccctgtgcgtcaccctgaactgtaccgaaatcaacaataactcaacgagaaatatcacagaagaataccgaatgactaactgttcctttaatatgacaaccgaactgcgagacaaaaagaaggctgaatacgcacttttctaccgaacagatgttgtaccaatcaacgagatgaacaatgaaaacaatggaacgaactctacctggtatagactgacaaactgtaacgttagcacaatcaagcaggcctgccctaaagtcacattcgaaccaataccaattcactactgcgcacccgccggattcgctattcttaagtgcgtggataagaagtttaacggaactggaacctgcaataatgtatctacagtacaatgcacgcatggaattaagcctgtcgtttcaacccagttgctgctgaatggatcactcgcagaaaaggatattattatctcaagcgaaaacatatctgataatgcaaaggtcatcatcgtccacctcaaccgctcagttgaaataaactgcactcggcctaataataacacaagacgctctgtcgcaatcggcccaggacaagctttttacactaccggggaagttatcggcgacatacggaaagcccactgcaacgttagctggaccaagtggaatgaaacactgcgcgatgttcaagccaaacttcaagaatacttcataaacaaatcaattgagttcaattctagctctggcggcgacctcgagattacaactcactcctttaactgcggcggcgaattcttttattgtaatacctccggtctcttcaacaactctatcctcaaaagtaacatttctgaaaataatgacacaatcacactgaattgcaagatcaagcagattgttaggatgtggcaacgagtcggacaagctatgtacgccccacccatcgccggaaatataacgtgtcgatcaaatatcactggcctcatccttactagagatggcggagacaataatagcaccagcgagatattcagaccaggcggaggcgatatgaaaaacaactggaggtcagagctctacaagtacaaaacagtcaaaattaaaagcctgggcattgctcccactcgggcccgcacactgactgtccaagtccgacagctcctgtccggaatcgtccaacaacagtccaacttgctgcgcgctatagaggctcaacaacatctccttcaactgactgtgtggggtatcaaacaattgagagcaagagtgctggcgctggaacggtatcttaaggaccaacaactcctgggcatatgggggtgttccggcaaactgatctgcacaacaaatgtaccctggaacaccagctggtcaaataaaagttataatgagatatgggaaaacatgacatggattgaatgggaaagggaaattgacaattatacataccatatatactctctcatcgaacaatctcagatacaacaggaaaagaatgaacaagatttgttggctcttgaccaatgggcttctttgtggagttggtaaagatcttacaa

SEQ ID NO: 65 - protein, 829 aa, Human immunodeficiency virus; identical to SEQ ID NO: 35

SEQ ID NO: 66 - protein, 830 aa, Human immunodeficiency virus
MRVMGIQRNCQHLWRWGILIFGMLMICSAAENLWVTVYYGVPVWKEANTTLFCASDAKAYDTEVHNVWATHACVPTDPNPQEIVLENVTENFNMWKNNMVEQMHEDIISLWDQSLKPCVKLTPLCVTLNCTDVNATNNSTNMGEIKNCSFNITTEIRDKKQKVYALFYRLDVVPINDNNSYRLINCNTSAITQACPKVSFEPIPIHYCAPAGFAILKCNDKKFNGTGPCKNVSTVQCTHGIKPVVSTQLLLNGSLAEEEIIIRSENITDNAKTIIVQLNESVEINCTRPNNNTRKSIRIGPGQAFYATGDIIGDIRQAHCNISGAEWNKTLQQVAAKLREHFNNKTIIFKPSSGGDLEITTHSFNCGGEFFYCNTSGLFNSTWNGTNETITLPCRIKQIVNMWQRVGQAMYAPPIAGNITCKSNITGLLLTRDGGTNNTETFRPGGGDMRDNWRSELYKYKVVKIEPLGVAPTKAKRRVVEREKRAVGIGAVFLGFLGAAGSTMGAASITLTVQARQLLSGIVQQQSNLLRAIEAQQHLLQLTVWGIKQLQARVLAVERYLKDQQLLGIWGCSGKLICTTNVPWNSSWSNKSQDEIWDNMTWMQWEREISNYTDIIYSLIEESQNQQEKNEQDLLALDKWASLWNWFDITNWLWYIKIFIMIVGGLIGLRIVFAVLSIVNRVRQGYSPLSFQTLIPNPRGPDRPGGIEEEGGEQDRDRSIRLVSGFLALAWDDLRSLCLFSYHRLRDFILIAARTVELLGRRGWEALKYLWNLLQYWGQELKNSAISLLDTTAIAVAEGTDRVIEVVQRACRAILHIPRRIRQGFERALL

SEQ ID NO: 67 - DNA, 2493 bp, Human immunodeficiency virus
atgcgcgtgatgggcatccagcgcaactgccagcacctgtggcgctggggcatcctgatcttcggcatgctgatgatctgctccgccgccgagaacctgtgggtgaccgtgtactacggcgtgcccgtgtggaaggaggccaacaccaccctgttctgcgcctccgacgccaaggcctacgacaccgaggtgcacaacgtgtgggccacccacgcctgcgtgcccaccgaccccaacccccaggagatcgtgctggagaacgtgaccgagaacttcaacatgtggaagaacaacatggtggagcagatgcacgaggacatcatctccctgtgggaccagtccctgaagccctgcgtgaagctgacccccctgtgcgtgaccctgaactgcaccgacgtgaacgccaccaacaactccaccaacatgggcgagatcaagaactgctccttcaacatcaccaccgagatccgcgacaagaagcagaaggtgtacgccctgttctaccgcctggacgtggtgcccatcaacgacaacaactcctaccgcctgatcaactgcaacacctccgccatcacccaggcctgccccaaggtgtccttcgagcccatccccatccactactgcgcccccgccggcttcgccatcctgaagtgcaacgacaagaagttcaacggcaccggcccctgcaagaacgtgtccaccgtgcagtgcacccacggcatcaagcccgtggtgtccacccagctgctgctgaacggctccctggccgaggaggagatcatcatccgctccgagaacatcaccgacaacgccaagaccatcatcgtgcagctgaacgagtccgtggagatcaactgcacccgccccaacaacaacacccgcaagtccatccgcatcggccccggccaggccttctacgccaccggcgacatcatcggcgacatccgccaggcccactgcaacatctccggcgccgagtggaacaagaccctgcagcaggtggccgccaagctgcgcgagcacttcaacaacaagaccatcatcttcaagccctcctccggcggcgacctggagatcaccacccactccttcaactgcggcggcgagttcttctactgcaacacctccggcctgttcaactccacctggaacggcaccaacgagaccatcaccctgccctgccgcatcaagcagatcgtgaacatgtggcagcgcgtgggccaggccatgtacgccccccccatcgccggcaacatcacctgcaagtccaacatcaccggcctgctgctgacccgcgacggcggcaccaacaacaccgagaccttccgccccggcggcggcgacatgcgcgacaactggcgctccgagctgtacaagtacaaggtggtgaagatcgagcccctgggcgtggcccccaccaaggccaagcgccgcgtggtggagcgcgagaagcgcgccgtgggcatcggcgccgtgttcctgggcttcctgggcgccgccggctccaccatgggcgccgcctccatcaccctgaccgtgcaggcccgccagctgctgtccggcatcgtgcagcagcagtccaacctgctgcgcgccatcgaggcccagcagcacctgctgcagctgaccgtgtggggcatcaagcagctgcaggcccgcgtgctggccgtggagcgctacctgaaggaccagcagctgctgggcatctggggctgctccggcaagctgatctgcaccaccaacgtgccctggaactcctcctggtccaacaagtcccaggacgagatctgggacaacatgacctggatgcagtgggagcgcgagatctccaactacaccgacatcatctactccctgatcgaggagtcccagaaccagcaggagaagaacgagcaggacctgctggccctggacaagtgggcctccctgtggaactggttcgacatcaccaactggctgtggtacatcaagatcttcatcatgatcgtgggcggcctgatcggcctgcgcatcgtgttcgccgtgctgtccatcgtgaaccgcgtgcgccagggctactcccccctgtccttccagaccctgatccccaacccccgcggccccgaccgccccggcggcatcgaggaggagggcggcgagcaggaccgcgaccgctccatccgcctggtgtccggcttcctggccctggcctgggacgacctgcgctccctgtgcctgttctcctaccaccgcctgcgcgacttcatcctgatcgccgcccgcaccgtggagctgctgggccgccgcggctgggaggccctgaagtacctgtggaacctgctgcagtactggggccaggagctgaagaactccgccatctccctgctggacaccaccgccatcgccgtggccgagggcaccgaccgcgtgatcgaggtggtgcagcgcgcctgccgcgccatcctgcacatcccccgccgcatccgccagggcttcgagcgcgccctgctgtaa

SEQ ID NO: 68 - protein, 845 aa, Human immunodeficiency virus; identical to SEQ ID NO: 38

SEQ ID NO: 69 - protein, 845 aa, Human immunodeficiency virus
MRVMGIQRNCQHLWRWGTMIFGMIIICSAAENLWVTVYYGVPVWKDAETTLFCASDAKAYDTEVHNVWATHACVPTDPNPQEIDLENVTEEFNMWKNNMVEQMHADIISLWDQSLKPCVKLTPLCVTLNCSNVNVTNNTTNTHEEEIKNCSFNMTTELRDKKQKVYSLFYRLDVVPINENNSNSSYRLINCNTSAITQACPKVSFEPIPIHYCAPAGFAILKCKDKEFNGTGPCKNVSTVQCTHGIKPVVSTQLLLNGSLAEEEVMIRSENITDNAKTIIVQLTEPVKINCTRPNNNTRKSIRIGPGQAFYATGDIIGDIRQAHCNVSRTEWNKTLQKVAAQLRKHFNNKTIIFNSSSGGDLEITTHSFNCGGEFFYCNTSGLFNSTWNNGTMKDTITLPCRIKQIINMWQRVGQAMYAPPIQGVIRCESNITGLLLTRDGGNNNTNETFRPGGGDMRDNWRSELYKYKVVKIEPLGVAPTRAKRRVVEREKRAVGLGAVFLGFLGAAGSTMGAASITLTVQARQLLSGIVQQQSNLLRAIEAQQHLLKLTVWGIKQLQARVLAVERYLKDQQLLGIWGCSGKLICTTNVPWNSSWSNKSQDEIWDNMTWLQWDKEISNYTDIIYNLIEESQNQQEKNEQDLLALDKWANLWNWFDISNWLWYIKIFIMIVGGLIGLRIVFAVLSVINRVRQGYSPLSFQTLTPNPEGPDRPGRIEEEGGEQGRDRSIRLVSGFLALAWDDLRSLCLFSYHRLRDFILIAARTVELLGRSSLKGLRLGWEGLKYLWNLLLYWGRELKISAINLLDTIAIAVAGWTDRVIEIGQRICRAILNIPRRIRQGLERALL

SEQ ID NO: 70 - DNA, 2538 bp, Human immunodeficiency virus
atgcgcgtgatgggcatccagcgcaactgccagcacctgctgcgctggggcaccatgatcctgggcatgatcatcatctgctccgccgccgagaacctgtgggtgaccgtgtactacggcgtgcccgtgtggaaggacgccgagaccaccctgttctgcgcctccgacgccaaggcctacgagaccgagatgcacaacgtgtgggccacccacgcctgcgtgcccaccgaccccaacccccaggagatccacctggagaacgtgaccgaggagttcaacatgtggaagaacaacatggtggagcagatgcacaccgacatcatctccctgtgggaccagtccctgaagccctgcgtgaagctgacccccctgtgcgtgaccctgaactgctccaacgtgaacgtgaccaacaacaccaccaacacccacgaggaggagatcaagaactgctccttcaacatgaccaccgagctgcgcgacaagaagcagaaggtgtactccctgttctaccgcctggacgtggtgcagatcaacgagaacaactccaactcctcctaccgcctgatcaactgcaacacctccgccatcacccaggcctgccccaaggtgtccttcgagcccatccccatccactactgcgcccccgccggcttcgccatcctgaagtgcaaggacaaggagttcaacggcaccggcccctgcaagaacgtgtccaccgtgcagtgcacccacggcatcaagcccgtggtgtccacccagctgctgctgaacggctccctggccgaggaggaggtgatcatccgctccgagaacatcaccaacaacgccaagaccatcatcgtgcagctgaccaagcccgtgaagatcaactgcacccgccccaacaacaacacccgcaagtccatccgcatcggccccggccaggccttctacgccaccggcgacatcatcggcgacatccgccaggcccactgcaacgtgtcccgctccgagtggaacaagaccctgcagaaggtggccaagcagctgcgcaagtacttcaagaacaagaccatcatcttcaccaactcctccggcggcgacctggagatcaccacccactccttcaactgcggcggcgagttcttctactgcaacacctccggcctgttcaactccacctggaacaacggcaccatgaagaacaccatcaccctgccctgccgcatcaagcagatcatcaacatgtggcagcgcgccggccaggccatgtacgccccccccatccagggcgtgatccgctgcgagtccaacatcaccggcctgctgctgacccgcgacggcggcaacaacaacaccaacgagaccttccgccccggcggcggcgacatgcgcgacaactggcgctccgagctgtacaagtacaaggtggtgaagatcgagcccctgggcgtggcccccacccgcgccaagcgccgcgtggtggagcgcgagaagcgcgccgtgggcatcggcgccgtgttcctgggcttcctgggcgccgccggctccaccatgggcgccgcctccatcaccctgaccgtgcaggcccgccagctgctgtccggcatcgtgcagcagcagtccaacctgctgcgcgccatcgaggcccagcagcacctgctgaagctgaccgtgtggggcatcaagcagctgcaggcccgcgtgctggccgtggagcgctacctgaaggaccagcagctgctgggcatctggggctgctccggcaagctgatctgcaccaccaacgtgccctggaactcctcctggtccaacaagtcccagaacgagatctgggacaacatgacctggctgcagtgggacaaggagatctccaactacacccacatcatctacaacctgatcgaggagtcccagaaccagcaggagaagaacgagcaggacctgctggccctggacaagtgggccaacctgtggaactggttcgacatctccaactggctgtggtacatcaagatcttcatcatgatcgtgggcggcctgatcggcctgcgcatcgtgttcgccgtgctgtccgtgatcaaccgcgtgcgccagggctactcccccctgtccttccagacccacacccccaacccccgcggcctggaccgccccggccgcatcgaggaggagggcggcgagcagggccgcgaccgctccatccgcctggtgtccggcttcctggccctggcctgggacgacctgcgctccctgtgcctgttctcctaccaccgcctgcgcgacttcatcctgatcgccgcccgcaccgtggagctgctgggccactcctccctgaagggcctgcgcctgggctgggagggcctgaagtacctgtggaacctgctgctgtactggggccgcgagctgaagatctccgccatcaacctggtggacaccatcgccatcgccgtggccggctggaccgaccgcgtgatcgagatcggccagcgcatcggccgcgccatcctgcacatcccccgccgcatccgccagggcctggagcgcgccctgctgtaa

SEQ ID NO: 71 - DNA, 2538 bp, Human immunodeficiency virus
atgcgcgtgatgggcatccagcgcaactgccagcacctgtggcgctggggcaccatgatcttcggcatgatcatcatctgctccgccgccgagaacctgtgggtgaccgtgtactacggcgtgcccgtgtggaaggacgccgagaccaccctgttctgcgcctccgacgccaaggcctacgacaccgaggtgcacaacgtgtgggccacccacgcctgcgtgcccaccgaccccaacccccaggagatcgacctggagaacgtgaccgaggagttcaacatgtggaagaacaacatggtggagcagatgcacgccgacatcatctccctgtgggaccagtccctgaagccctgcgtgaagctgacccccctgtgcgtgaccctgaactgctccaacgtgaacgtgaccaacaacaccaccaacacccacgaggaggagatcaagaactgctccttcaacatgaccaccgagctgcgcgacaagaagcagaaggtgtactccctgttctaccgcctggacgtggtgcccatcaacgagaacaactccaactcctcctaccgcctgatcaactgcaacacctccgccatcacccaggcctgccccaaggtgtccttcgagcccatccccatccactactgcgcccccgccggcttcgccatcctgaagtgcaaggacaaggagttcaacggcaccggcccctgcaagaacgtgtccaccgtgcagtgcacccacggcatcaagcccgtggtgtccacccagctgctgctgaacggctccctggccgaggaggaggtgatgatccgctccgagaacatcaccgacaacgccaagaccatcatcgtgcagctgaccgagcccgtgaagatcaactgcacccgccccaacaacaacacccgcaagtccatccgcatcggccccggccaggccttctacgccaccggcgacatcatcggcgacatccgccaggcccactgcaacgtgtcccgcaccgagtggaacaagaccctgcagaaggtggccgcccagctgcgcaagcacttcaacaacaagaccatcatcttcaactcctcctccggcggcgacctggagatcaccacccactccttcaactgcggcggcgagttcttctactgcaacacctccggcctgttcaactccacctggaacaacggcaccatgaaggacaccatcaccctgccctgccgcatcaagcagatcatcaacatgtggcagcgcgtgggccaggccatgtacgccccccccatccagggcgtgatccgctgcgagtccaacatcaccggcctgctgctgacccgcgacggcggcaacaacaacaccaacgagaccttccgccccggcggcggcgacatgcgcgacaactggcgctccgagctgtacaagtacaaggtggtgaagatcgagcccctgggcgtggcccccacccgcgccaagcgccgcgtggtggagcgcgagaagcgcgccgtgggcctgggcgccgtgttcctgggcttcctgggcgccgccggctccaccatgggcgccgcctccatcaccctgaccgtgcaggcccgccagctgctgtccggcatcgtgcagcagcagtccaacctgctgcgcgccatcgaggcccagcagcacctgctgaagctgaccgtgtggggcatcaagcagctgcaggcccgcgtgctggccgtggagcgctacctgaaggaccagcagctgctgggcatctggggctgctccggcaagctgatctgcaccaccaacgtgccctggaactcctcctggtccaacaagtcccaggacgagatctgggacaacatgacctggctgcagtgggacaaggagatctccaactacaccgacatcatctacaacctgatcgaggagtcccagaaccagcaggagaagaacgagcaggacctgctggccctggacaagtgggccaacctgtggaactggttcgacatctccaactggctgtggtacatcaagatcttcatcatgatcgtgggcggcctgatcggcctgcgcatcgtgttcgccgtgctgtccgtgatcaaccgcgtgcgccagggctactcccccctgtccttccagaccctgacccccaaccccgagggccccgaccgccccggccgcatcgaggaggagggcggcgagcagggccgcgaccgctccatccgcctggtgtccggcttcctggccctggcctgggacgacctgcgctccctgtgcctgttctcctaccaccgcctgcgcgacttcatcctgatcgccgcccgcaccgtggagctgctgggccgctcctccctgaagggcctgcgcctgggctgggagggcctgaagtacctgtggaacctgctgctgtactggggccgcgagctgaagatctccgccatcaacctgctggacaccatcgccatcgccgtggccggctggaccgaccgcgtgatcgagatcggccagcgcatctgccgcgccatcctgaacatcccccgccgcatccgccagggcctggagcgcgccctgctgtaa

SEQ ID NO: 72 - DNA, 2532 bp, Human immunodeficiency virus
atgcgcgtgatgggcacccagcgcaactaccagcacctgtggcgctggggcatcctgatcctgggcatgctgatcatgtgcaaggccaccgacctgtgggtgaccgtgtactacggcgtgcccgtgtggaaggacgccgacaccaccctgttctgcgcctccgacgccaaggcctacgacaccgaggtgcacaacgtgtgggccacccacgcctgcgtgcccaccgaccccaacccccaggaggtgaacctggagaacgtgaccgaggacttcaacatgtggaagaacaacatggtggagcagatgcacgaggacatcatctccctgtgggaccagtccctgaagccctgcgtgaagctgacccccctgtgcgtgaccctgaactgctccaacgccaacaccaccaacaactccaccatggaggagatcaagaactgctcctacaacatcaccaccgagctgcgcgacaagacccagaaggtgtactccctgttctacaagctggacgtggtgcagctggacgagtccaacaagtccgagtactactaccgcctgatcaactgcaacacctccgccatcacccaggcctgccccaaggtgtccttcgagcccatccccatccactactgcgcccccgccggcttcgccatcctgaagtgcaaggacccccgcttcaacggcaccggctcctgcaacaacgtgtcctccgtgcagtgcacccacggcatcaagcccgtggcctccacccagctgctgctgaacggctccctggccgagggcaaggtgatgatccgctccgagaacatcaccaacaacgccaagaacatcatcgtgcagttcaacaagcccgtgcccatcacctgcatccgccccaacaacaacacccgcaagtccatccgcttcggccccggccaggccttctacaccaacgacatcatcggcgacatccgccaggcccactgcaacatcaacaagaccaagtggaacgccaccctgcagaaggtggccgagcagctgcgcgagcacttccccaacaagaccatcatcttcaccaactcctccggcggcgacctggagatcaccacccactccttcaactgcggcggcgagttcttctactgcaacaccaccggcctgttcaactccacctggaagaacggcaccaccaacaacaccgagcagatgatcaccctgccctgccgcatcaagcagatcatcaacatgtggcagcgcgtgggccgcgccatgtacgccccccccatcgccggcgtgatcaagtgcacctccaacatcaccggcatcatcctgacccgcgacggcggcaacaacgagaccgagaccttccgccccggcggcggcgacatgcgcgacaactggcgctccgagctgtacaagtacaaggtggtgaagatcgagcccctgggcgtggcccccacccgcgccaagcgccgcgtggtggagcgcgagaagcgcgccgtgggcatgggcgccgtgttcctgggcttcctgggcgccgccggctccaccatgggcgccgcctccatcaccctgaccgtgcaggcccgccagctgctgtccggcatcgtgcagcagcagtccaacctgctgaaggccatcgaggcccagcagcacctgctgaagctgaccgtgtggggcatcaagcagctgcaggcccgcgtgctggccctggagcgctacctgcaggaccagcagctgctgggcatctggggctgctccggcaagctgatctgcgccaccaccgtgccctggaactcctcctggtccaacaagacccaggaggagatctggaacaacatgacctggctgcagtgggacaaggagatctccaactacaccaacatcatctacaagctgctggaggagtcccagaaccagcaggagaagaacgagcaggacctgctggccctggacaagtgggccaacctgtggaactggttcaacatcaccaactggctgtggtacatccgcatcttcatcatgatcgtgggcggcctgatcggcctgcgcatcgtgatcgccatcatctccgtggtgaaccgcgtgcgccagggctactcccccctgtccttccagatccccacccccaaccccgagggcctggaccgccccggccgcatcgaggagggcggcggcgagcagggccgcgaccgctccatccgcctggtgtccggcttcctggccctggcctgggacgacctgcgctccctgtgcctgttctcctaccaccgcctgcgcgactgcatcctgatcgccgcccgcaccgtggagctgctgggccactcctccctgaagggcctgcgcctgggctgggagggcctgaagtacctgtggaacctgctgctgtactggggccgcgagctgaagaactccgccatctccctgctggacaccatcgccgtggccgtggccgagtggaccgaccgcgtgatcgagatcggccagcgcgcctgccgcgccatcctgaacatcccccgccgcatccgccagggcttcgagcgcgccctgctgtaa

SEQ ID NO: 73 - protein, 843 aa, Human immunodeficiency virus
MRVMGTQRNYQHLWRWGILILGMLIMCKATDLWVTVYYGVPVWKDADTTLFCASDAKAYDTEVHNVWATHACVPTDPNPQEVNLENVTEDFNMWKNNMVEQMHEDIISLWDQSLKPCVKLTPLCVTLNCSNANTTNNSTMEEIKNCSYNITTELRDKTQKVYSLFYKLDVVQLDESNKSEYYYRLINCNTSAITQACPKVSFEPIPIHYCAPAGFAILKCKDPRFNGTGSCNNVSSVQCTHGIKPVASTQLLLNGSLAEGKVMIRSENITNNAKNIIVQFNKPVPITCIRPNNNTRKSIRFGPGQAFYTNDIIGDIRQAHCNINKTKWNATLQKVAEQLREHFPNKTIIFTNSSGGDLEITTHSFNCGGEFFYCNTTGLFNSTWKNGTTNNTEQMITLPCRIKQIINMWQRVGRAMYAPPIAGVIKCTSNITGIILTRDGGNNETETFRPGGGDMRDNWRSELYKYKVVKIEPLGVAPTRAKRRVVEREKRAVGMGAVFLGFLGAAGSTMGAASITLTVQARQLLSGIVQQQSNLLKAIEAQQHLLKLTVWGIKQLQARVLALERYLQDQQLLGIWGCSGKLICATTVPWNSSWSNKTQEEIWNNMTWLQWDKEISNYTNIIYKLLEESQNQQEKNEQDLLALDKWANLWNWFNITNWLWYIRIFIMIVGGLIGLRIVIAIISVVNRVRQGYSPLSFQIPTPNPEGLDRPGRIEEGGGEQGRDRSIRLVSGFLALAWDDLRSLCLFSYHRLRDCILIAARTVELLGHSSLKGLRLGWEGLKYLWNLLLYWGRELKNSAISLLDTIAVAVAEWTDRVIEIGQRACRAILNIPRRIRQGFERALL

SEQ ID NO: 74 - protein, 841 aa, Human immunodeficiency virus; identical to SEQ ID NO: 32

SEQ ID NO: 75 - DNA, 2532 bp, Human immunodeficiency virus; identical to SEQ ID NO: 72

SEQ ID NO: 76 - DNA, 2526 bp, Human immunodeficiency virus
atgcgcgtgaagggcatccgcaagaactaccagcacctgtggcgctggggcaccatgctgctgggcatgctgatgatctgctccgccgccgagaagctgtgggtgaccgtgtactacggcgtgcccgtgtggaaggaggccaccaccaccctgttctgcgcctccgacgccaaggcctacgacaccgaggtgcacaacgtgtgggccacccacgcctgcgtgcccaccgaccccaacccccaggaggtggtgctggagaacgtgaccgagaacttcaacatgtggaagaacaacatggtggagcagatgcacgaggacatcatctccctgtgggaccagtccctgaagccctgcgtgaagctgacccccctgtgcgtgaccctgaactgcaccgacctgatgaacgccaccaacaccaacaccaccatcatctaccgctggcgcggcgagatcaagaactgctccttcaacatcaccacctccatccgcgacaaggtgcagaaggagtacgccctgttctacaagctggacgtggtgcccatcgacaacgacaacacctcctaccgcctgatctcctgcaacacctccgtgatcacccaggcctgccccaaggtgtccttcgagcccatccccatccactactgcgcccccgccggcttcgccatcctgaagtgcaacgacaagaagttcaacggcaccggcccctgcaccaacgtgtccaccgtgcagtgcacccacggcatccgccccgtggtgtccacccagctgctgctgaacggctccctggccgaggaggaggtggtgatccgctccgagaacttcaccgacaacgccaagaccatcatcgtgcagctgaacgagtccgtggagatcaactgcacccgccccaacaacaacacccgcaagtccatccacatcggccccggccgcgccttctacaccaccggcgagatcatcggcgacatccgccaggcccactgcaacatctcccgcgccaagtggaacaacaccctgaagcagatcgtgaagaagctgcgcgagcagttcggcaacaagaccatcgtgttcaaccagtcctccggcggcgaccccgagatcgtgatgcactccttcaactgcggcggcgagttcttctactgcaacaccacccagctgttcaactccacctggaacggcacctggaacaacaccgagggcaacatcaccctgccctgccgcatcaagcagatcatcaacatgtggcaggaggtgggcaaggccatgtacgccccccccatccgcggccagatccgctgctcctccaacatcaccggcctgctgctgacccgcgacggcggcaacaacgagaccgagatcttccgccccggcggcggcgacatgcgcgacaactggcgctccgagctgtacaagtacaaggtggtgaagatcgagcccctgggcgtggcccccaccaaggccaagcgccgcgtggtgcagcgcgagaagcgcgccgtgggcatcggcgccatgttcctgggcttcctgggcgccgccggctccaccatgggcgccgcctccatgaccctgaccgtgcaggcccgccagctgctgtccggcatcgtgcagcagcagaacaacctgctgcgcgccatcgaggcccagcagcacctgctgcagctgaccgtgtggggcatcaagcagctgcaggcccgcgtgctggccgtggagcgctacctgaaggaccagcagctgctgggcatctggggctgctccggcaagctgatctgcaccaccgccgtgccctggaacgcctcctggtccaacaagtccctggacgagatctgggacaacatgacctggatggagtgggagcgcgagatcgacaactacacctccctgatctacaccctgatcgaggagtcccagaaccagcaggagaagaacgagcaggagctgctggagctggacaagtgggcctccctgtggaactggttcgacatcaccaactggctgtggtacatcaagatcttcatcatgatcgtgggcggcctggtgggcctgcgcatcgtgttcgccgtgctgtccatcgtgaaccgcgtgcgccagggctactcccccctgtccttccagacccgcctgcccgccccccgcggccccgaccgccccgagggcatcgaggaggagggcggcgagcgcgaccgcgaccgctccggccgcctggtggacggcttcctggccctgatctgggacgacctgcgctccctgtgcctgttctcctaccaccgcctgcgcgacctgctgctgatcgtgacccgcatcgtggagctgctgggccgccgcggctgggaggtgctgaagtactggtggaacctgctgcagtactggtcccaggagctgaagaactccgccgtgtccctgctgaacgccaccgccatcgccgtggccgagggcaccgaccgcgtgatcgaggtggtgcagcgcgcctgccgcgccatcctgcacatcccccgccgcatccgccagggcctggagcgcgccctgctgtaa

SEQ ID NO: 77 - protein, 840 aa, Human immunodeficiency virus
MRVKGIRKNCQHLWRWGTMLLGMLMICSAAENLWVTVYYGVPVWKEATTTLFCASDAKAYETEVHNVWATHACVPTDPNPQEVVLENVTENFNMWKNNMVEQMHEDIISLWDQSLKPCVKLTPLCVTLNCTDLLNATNTNSTNMYRWRGEIKNCSFNITTSIRDKMQKEYALFYKLDVVPIDNNTSYRLINCNTSVITQACPKVSFEPIPIHYCTPAGFAILKCNDKKFNGTGPCKNVSTVQCTHGIRPVVSTQLLLNGSLAEEEVVIRSENFTDNAKTIIVQLNESVEINCTRPNNNTRKSIHIGPGRAFYATGEIIGDIRQAHCNLSRAKWNNTLKQVVTKLREQFDNKTIVFNPSSGGDPEIVMHSFNCGGEFFYCNTTQLFNSTWNGTWNNTEGNITLPCRIKQIINMWQEVGKAMYAPPIRGQIRCSSNITGLLLTRDGGNNETEIFRPGGGDMRDNWRSELYKYKVVKIEPLGVAPTKAKRRVVQREKRAVGIGAMFLGFLGAAGSTMGAASMTLTVQARQLLSGIVQQQNNLLRAIEAQQHLLQLTVWGIKQLQARVLAVERYLRDQQLLGIWGCSGKLICTTTVPWNASWSNKSLDEIWNNMTWMEWEREIDNYTGLIYTLIEESQNQQEKNEQELLELDKWASLWNWFDITNWLWYIKIFIMIVGGLVGLRIVFAVLSIVNRVRQGYSPLSFQTRLPAPRGPDRPEGIEEEGGERDRDRSGRLVNGFLALIWDDLRSLCLFSYHRLRDLLLIVARIVELLGRRGWEALKYWWNLLQYWSQELKNSAVSLLNATAIAVAEGTDRVIEVVQRACRAILHIPRRIRQGLERALL

SEQ ID NO: 78 - protein, 835 aa, Human immunodeficiency virus; identical to SEQ ID NO: 41

SEQ ID NO: 79 - DNA, 2523 bp, Human immunodeficiency virus
atgcgcgtgaagggcatccgcaagaactgccagcacctgtggcgctggggcaccatgctgctgggcatgctgatgatctgctccgccgccgagaacctgtgggtgaccgtgtactacggcgtgcccgtgtggaaggaggccaccaccaccctgttctgcgcctccgacgccaaggcctacgagaccgaggtgcacaacgtgtgggccacccacgcctgcgtgcccaccgaccccaacccccaggaggtggtgctggagaacgtgaccgagaacttcaacatgtggaagaacaacatggtggagcagatgcacgaggacatcatctccctgtgggaccagtccctgaagccctgcgtgaagctgacccccctgtgcgtgaccctgaactgcaccgacctgctgaacgccaccaacaccaactccaccaacatgtaccgctggcgcggcgagatcaagaactgctccttcaacatcaccacctccatccgcgacaagatgcagaaggagtacgccctgttctacaagctggacgtggtgcccatcgacaacaacacctcctaccgcctgatcaactgcaacacctccgtgatcacccaggcctgccccaaggtgtccttcgagcccatccccatccactactgcacccccgccggcttcgccatcctgaagtgcaacgacaagaagttcaacggcaccggcccctgcaagaacgtgtccaccgtgcagtgcacccacggcatccgccccgtggtgtccacccagctgctgctgaacggctccctggccgaggaggaggtggtgatccgctccgagaacttcaccgacaacgccaagaccatcatcgtgcagctgaacgagtccgtggagatcaactgcacccgccccaacaacaacacccgcaagtccatccacatcggccccggccgcgccttctacgccaccggcgagatcatcggcgacatccgccaggcccactgcaacctgtcccgcgccaagtggaacaacaccctgaagcaggtggtgaccaagctgcgcgagcagttcgacaacaagaccatcgtgttcaacccctcctccggcggcgaccccgagatcgtgatgcactccttcaactgcggcggcgagttcttctactgcaacaccacccagctgttcaactccacctggaacggcacctggaacaacaccgagggcaacatcaccctgccctgccgcatcaagcagatcatcaacatgtggcaggaggtgggcaaggccatgtacgccccccccatccgcggccagatccgctgctcctccaacatcaccggcctgctgctgacccgcgacggcggcaacaacgagaccgagatcttccgccccggcggcggcgacatgcgcgacaactggcgctccgagctgtacaagtacaaggtggtgaagatcgagcccctgggcgtggcccccaccaaggccaagcgccgcgtggtgcagcgcgagaagcgcgccgtgggcatcggcgccatgttcctgggcttcctgggcgccgccggctccaccatgggcgccgcctccatgaccctgaccgtgcaggcccgccagctgctgtccggcatcgtgcagcagcagaacaacctgctgcgcgccatcgaggcccagcagcacctgctgcagctgaccgtgtggggcatcaagcagctgcaggcccgcgtgctggccgtggagcgctacctgcgcgaccagcagctgctgggcatctggggctgctccggcaagctgatctgcaccaccaccgtgccctggaacgcctcctggtccaacaagtccctggacgagatctggaacaacatgacctggatggagtgggagcgcgagatcgacaactacaccggcctgatctacaccctgatcgaggagtcccagaaccagcaggagaagaacgagcaggagctgctggagctggacaagtgggcctccctgtggaactggttcgacatcaccaactggctgtggtacatcaagatcttcatcatgatcgtgggcggcctggtgggcctgcgcatcgtgttcgccgtgctgtccatcgtgaaccgcgtgcgccagggctactcccccctgtccttccagacccgcctgcccgccccccgcggccccgaccgccccgagggcatcgaggaggagggcggcgagcgcgaccgcgaccgctccggccgcctggtgaacggcttcctggccctgatctgggacgacctgcgctccctgtgcctgttctcctaccaccgcctgcgcgacctgctgctgatcgtggcccgcatcgtggagctgctgggccgccgcggctgggaggccctgaagtactggtggaacctgctgcagtactggtcccaggagctgaagaactccgccgtgtccctgctgaacgccaccgccatcgccgtggccgagggcaccgaccgcgtgatcgaggtggtgcagcgcgcctgccgcgccatcctgcacatcccccgccgcatccgccagggcctggagcgcgccctgctgtaa

SEQ ID NO: 80 - DNA, 2508 bp, Human immunodeficiency virus
atgcgcgtgcgcggcatcctgcgcaactgccagcagtggtggatctggggcatcctgggcttctggatgctgatgatctgcaacgtggtgggcaacctgtgggtgaccgtgtactacggcgtgcccgtgtggaaggaggccaagaccaccctgttctgcgcctccgacgccaaggcctacgagaaggaggtgcacaacgtgtgggccacccacgcctgcgtgcccaccgaccccaacccccaggagatcgtgctggagaacgtgaccgagaacttcaacatgtggaagaacgacatggtggaccagatgcacgaggacatcatctccctgtgggaccagtccctgaagccctgcgtgaagctgacccccctgtgcgtgaccctgaactgcaccaacgccaccaacgccaccaacaccatgggcgagatcaagaactgctccttcaacatcaccaccgagctgcgcgacaagaagcagaaggtgtacgccctgttctaccgcctggacatcgtgcccctgaacgagaacaactcctaccgcctgatcaactgcaacacctccgccatcacccaggcctgccccaaggtgtccttcgaccccatccccatccactactgcgcccccgccggctacgccatcctgaagtgcaacaacaagaccttcaacggcaccggcccctgcaacaacgtgtccaccgtgcagtgcacccacggcatcaagcccgtggtgtccacccagctgctgctgaacggctccctggccgaggaggagatcatcatccgctccgagaacctgaccaacaacgccaagaccatcatcgtgcacctgaacgagtccgtggagatcgtgtgcacccgccccaacaacaacacccgcaagtccatccgcatcggccccggccagaccttctacgccaccggcgacatcatcggcgacatccgccaggcccactgcaacatctccgaggacaagtggaacaagaccctgcagaaggtgtccaagaagctgaaggagcacttccccaacaagaccatcaagttcgagccctcctccggcggcgacctggagatcaccacccactccttcaactgccgcggcgagttcttctactgcaacacctccaagctgttcaactccacctacaactccaccaactccaccatcaccctgccctgccgcatcaagcagatcatcaacatgtggcaggaggtgggccgcgccatgtacgccccccccatcgccggcaacatcacctgcaagtccaacatcaccggcctgctgctgacccgcgacggcggcaagaacaacaccgagaccttccgccccggcggcggcgacatgcgcgacaactggcgctccgagctgtacaagtacaaggtggtggagatcaagcccctgggcatcgcccccaccaaggccaagcgccgcgtggtggagcgcgagaagcgcgccgtgggcatcggcgccgtgttcctgggcttcctgggcgccgccggctccaccatgggcgccgcctccatcaccctgaccgtgcaggcccgccagctgctgtccggcatcgtgcagcagcagtccaacctgctgcgcgccatcgaggcccagcagcacatgctgcagctgaccgtgtggggcatcaagcagctgcagacccgcgtgctggccatcgagcgctacctgaaggaccagcagctgctgggcatctggggctgctccggcaagctgatctgcaccaccgccgtgccctggaactcctcctggtccaacaagtcccaggaggacatctgggacaacatgacctggatgcagtgggaccgcgagatctccaactacaccgacaccatctaccgcctgctggaggactcccagaaccagcaggagaagaacgagaaggacctgctggccctggactcctggaagaacctgtggaactggttcgacatcaccaactggctgtggtacatcaagatcttcatcatgatcgtgggcggcctgatcggcctgcgcatcatcttcgccgtgctgtccatcgtgaaccgcgtgcgccagggctactcccccctgtccttccagaccctgacccccaacccccgcggccccgaccgcctgggccgcatcgaggaggagggcggcgagcaggaccgcgaccgctccatccgcctggtgtccggcttcctggccctggcctgggacgacctgcgctccctgtgcctgttctcctaccaccgcctgcgcgacttcatcctgatcgccgcccgcgccgtggagctgctgggccgctcctccctgcgcggcctgcagcgcggctgggaggccctgaagtacctgggctccctggtgcagtactggggcctggagctgaagaagtccgccatctccctgctggacaccatcgccatcgccgtggccgagggcaccgaccgcatcatcgagctgatccagcgcatctgccgcgccatccgcaacatcccccgccgcatccgccagggcttcgaggccgccctgcagtaa

SEQ ID NO: 81 - protein, 835 aa, Human immunodeficiency virus
MRVMGILRNCQQWWIWGILGFWMLMICNVVGNLWVTVYYGVPVWKEAKTTLFCASDAKAYEREVHNVWATHACVPTDPNPQEMVLENVTENFNMWKNDMVDQMHEDIISLWDQSLKPCVKLTPLCVTLNCTNATNATNTMGEMKNCSFNITTELRDKKQKVYALFYRLDIVPLNDNNSYRLINCNTSAITQACPKVSFDPIPIHYCAPAGYAILKCNNKTFNGTGPCNNVSTVQCTHGIKPVVSTQLLLNGSLAEEEIIIRSENLTDNAKTIIVHLNESVEIVCTRPNNNTRKSIRIGPGQTFYATGDIIGDIRQAHCNISEEKWNKTLQRVGEKLKEHFPNKTIKFAPSSGGDLEITTHSFNCRGEFFYCNTSRLFNSTYNSKNSTITLPCRIKQIINMWQGVGRAMYAPPIAGNITCKSNITGLLLTRDGGKNNTETFRPGGGDMRDNWRSELYKYKVVEIKPLGIAPTEAKRRVVEREKRAVGIGAVFLGFLGAAGSTMGAASITLTVQARQLLSGIVQQQSNLLRAIEAQQHMLQLTVWGIKQLQTRVLAIERYLKDQQLLGIWGCSGKLICTTAVPWNSSWSNKSQEEIWDNMTWMQWDREISNYTDTIYRLLEDSQNQQEKNEQDLLALDSWENLWNWFDITNWLWYIKIFIMIVGGLIGLRIIFAVLSIVNRVRQGYSPLSFQTLTPNPRGPDRLGRIEEEGGEQDRDRSIRLVSGFLALAWDDLRSLCLFSYHRLRDFILIAARAVELLGRSSLRGLQRGWEALKYLGSLVQYWGLELKKSAISLLDTIAIAVAEGTDRIIELIQRICRAIRNIPRRIRQGFEAALL

SEQ ID NO: 82 - protein, 840 aa, Human immunodeficiency virus
MRVRGIQRNYQHLWRWGIMLLGMLMICSVAENLWVTVYYGVPVWKEATTTLFCASDAKSYKTEAHNIWATHACVPTDPNPQEIELENVTENFNMWKNNMVEQMHEDIISLWDQSLKPCVKLTPLCVTLNCTDVKRNNTSNDTNEGEMKNCSFNITTEIRDKKKQVHALFYKLDVVPIDDNNSNTSYRLINCNTSAITQACPKVTFEPIPIHYCAPAGFAILKCKDKKFNGTGPCKNVSTVQCTHGIRPVVSTQLLLNGSLAEEEIIIRSENLTNNAKIIIVQLNESVTINCTRPYNNTRQRTPIGPGQALYTTRIKGDIRQAHCNISRAEWNKTLQQVAKKLGDLLNKTTIIFKPSSGGDPEITTHSFNCGGEFFYCNTSRLFNSTWNNTKWNSTGKITLPCRIKQIINMWQGVGKAMYAPPIEGLIKCSSNITGLLLTRDGGANNSHNETFRPGGGDMRDNWRSELYKYKVVKIEPLGVAPTRAKRRVVEREKRAIGLGAMFLGFLGAAGSTMGAASMTLTVQARQLLSGIVQQQNNLLRAIEAQQHLLQLTVWGIKQLQARILAVERYLKDQQLLGIWGCSGKHICTTTVPWNSSWSNKSLDEIWNNMTWMEWEREIDNYTGLIYSLIEESQNQQEKNEQELLELDKWASLWNWFSITQWLWYIKIFIMIVGGLIGLRIVFAVLSLVNRVRQGYSPLSFQTLLPAPRGPDRPEGIEEEGGEQGRGRSIRLVNGFSALIWDDLRNLCLFSYHRLRDLILIAARIVELLGRRGWEALKYLWNLLQYWIQELKNSAISLFDTTAIAVAEGTDRVIEIVQRACRAILNIPTRIRQGLERALL

SEQ ID NO: 83 - DNA, 2508 bp, Human immunodeficiency virus
atgcgcgtgatgggcatcctgcgcaactgccagcagtggtggatctggggcatcctgggcttctggatgctgatgatctgcaacgtggtgggcaacctgtgggtgaccgtgtactacggcgtgcccgtgtggaaggaggccaagaccaccctgttctgcgcctccgacgccaaggcctacgagcgcgaggtgcacaacgtgtgggccacccacgcctgcgtgcccaccgaccccaacccccaggagatggtgctggagaacgtgaccgagaacttcaacatgtggaagaacgacatggtggaccagatgcacgaggacatcatctccctgtgggaccagtccctgaagccctgcgtgaagctgacccccctgtgcgtgaccctgaactgcaccaacgccaccaacgccaccaacaccatgggcgagatgaagaactgctccttcaacatcaccaccgagctgcgcgacaagaagcagaaggtgtacgccctgttctaccgcctggacatcgtgcccctgaacgacaacaactcctaccgcctgatcaactgcaacacctccgccatcacccaggcctgccccaaggtgtccttcgaccccatccccatccactactgcgcccccgccggctacgccatcctgaagtgcaacaacaagaccttcaacggcaccggcccctgcaacaacgtgtccaccgtgcagtgcacccacggcatcaagcccgtggtgtccacccagctgctgctgaacggctccctggccgaggaggagatcatcatccgctccgagaacctgaccgacaacgccaagaccatcatcgtgcacctgaacgagtccgtggagatcgtgtgcacccgccccaacaacaacacccgcaagtccatccgcatcggccccggccagaccttctacgccaccggcgacatcatcggcgacatccgccaggcccactgcaacatctccgaggagaagtggaacaagaccctgcagcgcgtgggcgagaagctgaaggagcacttccccaacaagaccatcaagttcgccccctcctccggcggcgacctggagatcaccacccactccttcaactgccgcggcgagttcttctactgcaacacctcccgcctgttcaactccacctacaactccaagaactccaccatcaccctgccctgccgcatcaagcagatcatcaacatgtggcagggcgtgggccgcgccatgtacgccccccccatcgccggcaacatcacctgcaagtccaacatcaccggcctgctgctgacccgcgacggcggcaagaacaacaccgagaccttccgccccggcggcggcgacatgcgcgacaactggcgctccgagctgtacaagtacaaggtggtggagatcaagcccctgggcatcgcccccaccgaggccaagcgccgcgtggtggagcgcgagaagcgcgccgtgggcatcggcgccgtgttcctgggcttcctgggcgccgccggctccaccatgggcgccgcctccatcaccctgaccgtgcaggcccgccagctgctgtccggcatcgtgcagcagcagtccaacctgctgcgcgccatcgaggcccagcagcacatgctgcagctgaccgtgtggggcatcaagcagctgcagacccgcgtgctggccatcgagcgctacctgaaggaccagcagctgctgggcatctggggctgctccggcaagctgatctgcaccaccgccgtgccctggaactcctcctggtccaacaagtcccaggaggagatctgggacaacatgacctggatgcagtgggaccgcgagatctccaactacaccgacaccatctaccgcctgctggaggactcccagaaccagcaggagaagaacgagcaggacctgctggccctggactcctgggagaacctgtggaactggttcgacatcaccaactggctgtggtacatcaagatcttcatcatgatcgtgggcggcctgatcggcctgcgcatcatcttcgccgtgctgtccatcgtgaaccgcgtgcgccagggctactcccccctgtccttccagaccctgacccccaacccccgcggccccgaccgcctgggccgcatcgaggaggagggcggcgagcaggaccgcgaccgctccatccgcctggtgtccggcttcctggccctggcctgggacgacctgcgctccctgtgcctgttctcctaccaccgcctgcgcgacttcatcctgatcgccgcccgcgccgtggagctgctgggccgctcctccctgcgcggcctgcagcgcggctgggaggccctgaagtacctgggctccctggtgcagtactggggcctggagctgaagaagtccgccatctccctgctggacaccatcgccatcgccgtggccgagggcaccgaccgcatcatcgagctgatccagcgcatctgccgcgccatccgcaacatcccccgccgcatccgccagggcttcgaggccgccctgctgtaa

SEQ ID NO: 84 - DNA, 2523 bp, Human immunodeficiency virus
atgcgcgtgcgcggcatccagcgcaactaccagcacctgtggcgctggggcatcatgctgctgggcatgctgatgatctgctccgtggccgagaacctgtgggtgaccgtgtactacggcgtgcccgtgtggaaggaggccaccaccaccctgttctgcgcctccgacgccaagtcctacaagaccgaggcccacaacatctgggccacccacgcctgcgtgcccaccgaccccaacccccaggagatcgagctggagaacgtgaccgagaacttcaacatgtggaagaacaacatggtggagcagatgcacgaggacatcatctccctgtgggaccagtccctgaagccctgcgtgaagctgacccccctgtgcgtgaccctgaactgcaccgacgtgaagcgcaacaacacctccaacgacaccaacgagggcgagatgaagaactgctccttcaacatcaccaccgagatccgcgacaagaagaagcaggtgcacgccctgttctacaagctggacgtggtgcccatcgacgacaacaactccaacacctcctaccgcctgatcaactgcaacacctccgccatcacccaggcctgccccaaggtgaccttcgagcccatccccatccactactgcgcccccgccggcttcgccatcctgaagtgcaaggacaagaagttcaacggcaccggcccctgcaagaacgtgtccaccgtgcagtgcacccacggcatccgccccgtggtgtccacccagctgctgctgaacggctccctggccgaggaggagatcatcatccgctccgagaacctgaccaacaacgccaagatcatcatcgtgcagctgaacgagtccgtgaccatcaactgcacccgcccctacaacaacacccgccagcgcacccccatcggccccggccaggccctgtacaccacccgcatcaagggcgacatccgccaggcccactgcaacatctcccgcgccgagtggaacaagaccctgcagcaggtggccaagaagctgggcgacctgctgaacaagaccaccatcatcttcaagccctcctccggcggcgaccccgagatcaccacccactccttcaactgcggcggcgagttcttctactgcaacacctcccgcctgttcaactccacctggaacaacaccaagtggaactccaccggcaagatcaccctgccctgccgcatcaagcagatcatcaacatgtggcagggcgtgggcaaggccatgtacgccccccccatcgagggcctgatcaagtgctcctccaacatcaccggcctgctgctgacccgcgacggcggcgccaacaactcccacaacgagaccttccgccccggcggcggcgacatgcgcgacaactggcgctccgagctgtacaagtacaaggtggtgaagatcgagcccctgggcgtggcccccacccgcgccaagcgccgcgtggtggagcgcgagaagcgcgccatcggcctgggcgccatgttcctgggcttcctgggcgccgccggctccaccatgggcgccgcctccatgaccctgaccgtgcaggcccgccagctgctgtccggcatcgtgcagcagcagaacaacctgctgcgcgccatcgaggcccagcagcacctgctgcagctgaccgtgtggggcatcaagcagctgcaggcccgcatcctggccgtggagcgctacctgaaggaccagcagctgctgggcatctggggctgctccggcaagcacatctgcaccaccaccgtgccctggaactcctcctggtccaacaagtccctggacgagatctggaacaacatgacctggatggagtgggagcgcgagatcgacaactacaccggcctgatctactccctgatcgaggagtcccagaaccagcaggagaagaacgagcaggagctgctggagctggacaagtgggcctccctgtggaactggttctccatcacccagtggctgtggtacatcaagatcttcatcatgatcgtgggcggcctgatcggcctgcgcatcgtgttcgccgtgctgtccctggtgaaccgcgtgcgccagggctactcccccctgtccttccagaccctgctgcccgccccccgcggccccgaccgccccgagggcatcgaggaggagggcggcgagcagggccgcggccgctccatccgcctggtgaacggcttctccgccctgatctgggacgacctgcgcaacctgtgcctgttctcctaccaccgcctgcgcgacctgatcctgatcgccgcccgcatcgtggagctgctgggccgccgcggctgggaggccctgaagtacctgtggaacctgctgcagtactggatccaggagctgaagaactccgccatctccctgttcgacaccaccgccatcgccgtggccgagggcaccgaccgcgtgatcgagatcgtgcagcgcgcctgccgcgccatcctgaacatccccacccgcatccgccagggcctggagcgcgccctgctgtaa

SEQ ID NO: 85 - protein, 832 aa, Human immunodeficiency virus
MRVRGMQRNWQHLGKWGLLFLGILIICNAAENLWVTVYYGVPVWKEATTTLFCASDAKSYEKEVHNVWATHACVPTDPNPQEVVLENVTENFDMWKNNMVEQMHTDIISLWDQSLKPCVKLTPLCVTLNCTDVNATNNDTNDNKTGAIQNCSFNMTTEVRDKKLKVHALFYKLDIVPISNNNSKYRLINCNTSTITQACPKVSWDPIPIHYCAPAGYAILKCNDKRFNGTGPCKNVSTVQCTHGIKPVVSTQLLLNGSLAEEDIIIRSQNISDNAKTIIVHLNESVQINCTRPNNNTRKSIHLGPGQAFYATGEIIGDIRKAHCNISGTQWNKTLEQVKAKLKSHFPNKTIKFNSSSGGDLEITMHSFNCRGEFFYCNTSGLFNDTGSNGTITLPCRIKQIVNMWQEVGRAMYAAPIAGNITCNSNITGLLLTRDGGQNNTETFRPGGGNMKDNWRSELYKYKVVEIEPLGVAPTKAKRQVVKRERRAVGIGAVFLGFLGAAGSTMGAASITLTVQARQLLSGIVQQQNNLLRAIEAQQHLLQLTVWGIKQLQARVLAVERYLKDQQLLGLWGCSGKLICTTNVPWNSSWSNKSQDEIWNNMTWMEWEKEISNYSNIIYRLIEESQNQQEKNEQELLALDKWASLWNWFDISNWLWYIKIFIMIVGGLIGLRIVFAVLSIVNRVRKGYSPLSLQTLIPSPREPDRPEGIEEGGGEQGKDRSVRLVNGFLALVWDDLRNLCLFSYRHLRDFILIAARIVDRGLRRGWEALKYLGNLTQYWSQELKNSAISLLNTTAIVVAEGTDRVIEALQRAGRAVLNIPRRIRQGLERALL

SEQ ID NO: 86 - protein, 831 aa, Human immunodeficiency virus
MRVREMQRNWQHLGKWGLLFLGILIICNAADNLWVTVYYGVPVWKEATTTLFCASDAKAYEREVHNVWATYACVPTDPSPQELVLGNVTENFNMWKNNMVDQMHEDIISLWDQSLKPCVKLTPLCVTLNCTDVNVTINTTNVTLGEIKNCSFNITTEIKDKKKKEYALFYRLDVVPINNSIVYRLISCNTSTVTQACPKVSFEPIPIHYCAPAGFAILKCNDKKFNGTGLCRNVSTVQCTHGIRPVVSTQLLLNGSLAEEDIIIRSENISDNTKTIIVQFNRSVEINCTRPNNNTRKSIRIGPGRAFYATGDIIGDIRKAYCNINRTLWNETLKKVAEEFKNHFNITVTFNPSSGGDLEITTHSFNCRGEFFYCNTSDLFNNTEVNNTKTITLPCRIRQFVNMWQRVGRAMYAPPIAGQIQCNSNITGLLLTRDGGKNGSETLRPGGGDMRDNWRSELYKYKVVKIEPLGVAPTKAKRQVVQREKRAVGIGAVLLGFLGAAGSTMGAASITLTVQARQLLSGIVQQQSNLLKAIEAQQHLLQLTVWGIKQLQARILAVERYLKDQQLLGIWGCSGKLICTTNVPWNSSWSNKSQDEIWDNMTWMQWEKEISNYTDTIYRLIEDAQNQQEKNEQDLLALDKWDNLWSWFTITNWLWYIKIFIMIVGGLIGLRIVFAVLSVVNRVRQGYSPLSLQTLIPNPRGPERPGGIEEEGGEQDRDRSIRLVSGFLALAWDDLRSLCLFSYRHLRDFILIAARTVDMGLKRGWEALKYLWNLPQYWGQELKNSAISLLDTTAIAVAEGTDRIIEVLQRAGRAVLHIPRRIRQGFERALL

SEQ ID NO: 87 - DNA, 2499 bp, Human immunodeficiency virus
atgcgcgtgcgcggcatgcagcgcaactggcagcacctgggcaagtggggcctgctgttcctgggcatcctgatcatctgcaacgccgccgagaacctgtgggtgaccgtgtactacggcgtgcccgtgtggaaggaggccaccaccaccctgttctgcgcctccgacgccaagtcctacgagaaggaggtgcacaacgtgtgggccacccacgcctgcgtgcccaccgaccccaacccccaggaggtggtgctggagaacgtgaccgagaacttcgacatgtggaagaacaacatggtggagcagatgcacaccgacatcatctccctgtgggaccagtccctgaagccctgcgtgaagctgacccccctgtgcgtgaccctgaactgcaccgacgtgaacgccaccaacaacgacaccaacgacaacaagaccggcgccatccagaactgctccttcaacatgaccaccgaggtgcgcgacaagaagctgaaggtgcacgccctgttctacaagctggacatcgtgcccatctccaacaacaactccaagtaccgcctgatcaactgcaacacctccaccatcacccaggcctgccccaaggtgtcctgggaccccatccccatccactactgcgcccccgccggctacgccatcctgaagtgcaacgacaagcgcttcaacggcaccggcccctgcaagaacgtgtccaccgtgcagtgcacccacggcatcaagcccgtggtgtccacccagctgctgctgaacggctccctggccgaggaggacatcatcatccgctcccagaacatctccgacaacgccaagaccatcatcgtgcacctgaacgagtccgtgcagatcaactgcacccgccccaacaacaacacccgcaagtccatccacctgggccccggccaggccttctacgccaccggcgagatcatcggcgacatccgcaaggcccactgcaacatctccggcacccagtggaacaagaccctggagcaggtgaaggccaagctgaagtcccacttccccaacaagaccatcaagttcaactcctcctccggcggcgacctggagatcaccatgcactccttcaactgccgcggcgagttcttctactgcaacacctccggcctgttcaacgacaccggctccaacggcaccatcaccctgccctgccgcatcaagcagatcgtgaacatgtggcaggaggtgggccgcgccatgtacgccgcccccatcgccggcaacatcacctgcaactccaacatcaccggcctgctgctgacccgcgacggcggccagaacaacaccgagaccttccgccccggcggcggcaacatgaaggacaactggcgctccgagctgtacaagtacaaggtggtggagatcgagcccctgggcgtggcccccaccaaggccaagcgccaggtggtgaagcgcgagcgccgcgccgtgggcatcggcgccgtgttcctgggcttcctgggcgccgccggctccaccatgggcgccgcctccatcaccctgaccgtgcaggcccgccagctgctgtccggcatcgtgcagcagcagaacaacctgctgcgcgccatcgaggcccagcagcacctgctgcagctgaccgtgtggggcatcaagcagctgcaggcccgcgtgctggccgtggagcgctacctgaaggaccagcagctgctgggcctgtggggctgctccggcaagctgatctgcaccaccaacgtgccctggaactcctcctggtccaacaagtcccaggacgagatctggaacaacatgacctggatggagtgggagaaggagatctccaactactccaacatcatctaccgcctgatcgaggagtcccagaaccagcaggagaagaacgagcaggagctgctggccctggacaagtgggcctccctgtggaactggttcgacatctccaactggctgtggtacatcaagatcttcatcatgatcgtgggcggcctgatcggcctgcgcatcgtgttcgccgtgctgtccatcgtgaaccgcgtgcgcaagggctactcccccctgtccctgcagaccctgatcccctccccccgcgagcccgaccgccccgagggcatcgaggagggcggcggcgagcagggcaaggaccgctccgtgcgcctggtgaacggcttcctggccctggtgtgggacgacctgcgcaacctgtgcctgttctcctaccgccacctgcgcgacttcatcctgatcgccgcccgcatcgtggaccgcggcctgcgccgcggctgggaggccctgaagtacctgggcaacctgacccagtactggtcccaggagctgaagaactccgccatctccctgctgaacaccaccgccatcgtggtggccgagggcaccgaccgcgtgatcgaggccctgcagcgcgccggccgcgccgtgctgaacatcccccgccgcatccgccagggcctggagcgcgccctgctgtaa

SEQ ID NO: 88 - DNA, 2496 bp, Human immunodeficiency virus
atgcgcgtgcgcgagatgcagcgcaactggcagcacctgggcaagtggggcctgctgttcctgggcatcctgatcatctgcaacgccgccgacaacctgtgggtgaccgtgtactacggcgtgcccgtgtggaaggaggccaccaccaccctgttctgcgcctccgacgccaaggcctacgagcgcgaggtgcacaacgtgtgggccacctacgcctgcgtgcccaccgacccctccccccaggagctggtgctgggcaacgtgaccgagaacttcaacatgtggaagaacaacatggtggaccagatgcacgaggacatcatctccctgtgggaccagtccctgaagccctgcgtgaagctgacccccctgtgcgtgaccctgaactgcaccgacgtgaacgtgaccatcaacaccaccaacgtgaccctgggcgagatcaagaactgctccttcaacatcaccaccgagatcaaggacaagaagaagaaggagtacgccctgttctaccgcctggacgtggtgcccatcaacaactccatcgtgtaccgcctgatctcctgcaacacctccaccgtgacccaggcctgccccaaggtgtccttcgagcccatccccatccactactgcgcccccgccggcttcgccatcctgaagtgcaacgacaagaagttcaacggcaccggcctgtgccgcaacgtgtccaccgtgcagtgcacccacggcatccgccccgtggtgtccacccagctgctgctgaacggctccctggccgaggaggacatcatcatccgctccgagaacatctccgacaacaccaagaccatcatcgtgcagttcaaccgctccgtggagatcaactgcacccgccccaacaacaacacccgcaagtccatccgcatcggccccggccgcgccttctacgccaccggcgacatcatcggcgacatccgcaaggcctactgcaacatcaaccgcaccctgtggaacgagaccctgaagaaggtggccgaggagttcaagaaccacttcaacatcaccgtgaccttcaacccctcctccggcggcgacctggagatcaccacccactccttcaactgccgcggcgagttcttctactgcaacacctccgacctgttcaacaacaccgaggtgaacaacaccaagaccatcaccctgccctgccgcatccgccagttcgtgaacatgtggcagcgcgtgggccgcgccatgtacgccccccccatcgccggccagatccagtgcaactccaacatcaccggcctgctgctgacccgcgacggcggcaagaacggctccgagaccctgcgccccggcggcggcgacatgcgcgacaactggcgctccgagctgtacaagtacaaggtggtgaagatcgagcccctgggcgtggcccccaccaaggccaagcgccaggtggtgcagcgcgagaagcgcgccgtgggcatcggcgccgtgctgctgggcttcctgggcgccgccggctccaccatgggcgccgcctccatcaccctgaccgtgcaggcccgccagctgctgtccggcatcgtgcagcagcagtccaacctgctgaaggccatcgaggcccagcagcacctgctgcagctgaccgtgtggggcatcaagcagctgcaggcccgcatcctggccgtggagcgctacctgaaggaccagcagctgctgggcatctggggctgctccggcaagctgatctgcaccaccaacgtgccctggaactcctcctggtccaacaagtcccaggacgagatctgggacaacatgacctggatgcagtgggagaaggagatctccaactacaccgacaccatctaccgcctgatcgaggacgcccagaaccagcaggagaagaacgagcaggacctgctggccctggacaagtgggacaacctgtggtcctggttcaccatcaccaactggctgtggtacatcaagatcttcatcatgatcgtgggcggcctgatcggcctgcgcatcgtgttcgccgtgctgtccgtggtgaaccgcgtgcgccagggctactcccccctgtccctgcagaccctgatccccaacccccgcggccccgagcgccccggcggcatcgaggaggagggcggcgagcaggaccgcgaccgctccatccgcctggtgtccggcttcctggccctggcctgggacgacctgcgctccctgtgcctgttctcctaccgccacctgcgcgacttcatcctgatcgccgcccgcaccgtggacatgggcctgaagcgcggctgggaggccctgaagtacctgtggaacctgccccagtactggggccaggagctgaagaactccgccatctccctgctggacaccaccgccatcgccgtggccgagggcaccgaccgcatcatcgaggtgctgcagcgcgccggccgcgccgtgctgcacatcccccgccgcatccgccagggcttcgagcgcgccctgctgtaa

SEQ ID NO: 89 - protein, 842 aa, Human immunodeficiency virus; identical to SEQ ID NO: 44

SEQ ID NO: 90 - protein, 839 aa, Human immunodeficiency virus
TRVMETQRNYPSLWRWGTLILGMLLICSAAGNLWVTVYYGVPVWKEAKTTLFCASDAKAYETEKHNVWATHACVPTDPNPQEMVLENVTENFNMWENDMVEQMHTDIISLWDQSLKPCVKLTPLCVTLDCSNVNTTNATNSRFNMQEELTNCSFNVTTVIRDKQQKVHALFYRLDVVPIDDNNSYQYRLINCNTSVITQACPKVSFEPIPIHYCAPAGFAILKCNNKTFNGTGPCTNVSTVQCTHGIRPVVSTQLLLNGSLAEEQVIIRSKNISDNTKNIIVQLNKPVEITCTRPNNNTRKSIHLGPGQAFYATGDIIGDIRQAHCNISGKKWNKTLHQVVTQLGKYFDNRTIIFKPHSGGDMEVTTHSFNCRGEFFYCNTSGLFNSSWTNSTNDTKNIITLPCRIKQIVNMWQRVGQAMYAPPIKGNITCVSNITGLILTFDEGNNTVTFRPGGGDMRDNWRSELYKYKVVKIEPLGVAPTEARRRVVEREKRAVGMGAFFLGFLGAAGSTMGAASITLTVQARQLLSGIVQQQSNLLRAIQAQQHMLQLTVWGIKQLQARVLAVERYLKDQQLLGIWGCSGKLICTTNVPWNSSWSNKSLDEIWDNMTWMEWDKQINNYTEEIYRLLEVSQTQQEKNEQDLLALDKWASLWNWFSITNWLWYIKIFIMIVGGLIGLRIIFAVLSIVNRVRQGYSPLSFQTLIPNPRGPDRPEGIEEEGGEQDRDRSVRLVNGFLPLVWDDLRSLCLFSYRLLRDLLLIVVRTVELLGRRGREALKYLWNLLQYWGQELKNSAINLLNTTAIAVAEGTDRIIEIVQRAWRAILHIPRRIRQGFERTLL

SEQ ID NO: 91 - DNA, 2529 bp, Human immunodeficiency virus
atgcgcgtgaagggcatccagcgcaactggcagcacctgtggaagtggggcaccctgatcctgggcctggtgatcatctgctccgcctccaacaacctgtgggtgaccgtgtactacggcgtgcccgtgtgggaggacgccgacaccaccctgttctgcgcctccgacgccaaggcctactccaccgagcgccacaacgtgtgggccacccacgcctgcgtgcccaccgaccccaacccccaggagatcaccctggagaacgtgaccgagaacttcaacatgtggaagaacaacatggtggagcagatgcacgaggacatcatctccctgtgggacgagtccctgaagccctgcgtgaagctgacccccctgtgcgtgaccctgaactgcaccgacgtgaacgtgaccaacaacaacaccaacaacaccaagaaggagatcaagaactgctccttcaacatcaccaccgagatccgcgacaagaagaagaaggagtacgccctgttctaccgcctggacgtggtgcccatcaacgacaacggcaactcctccatctaccgcctgatcaactgcaacgtgtccaccatcaagcaggcctgccccaaggtgaccttcgaccccatccccatccactactgcgcccccgccggcttcgccatcctgaagtgccgcgacaagaagttcaacggcaccggcccctgcaagaacgtgtccaccgtgcagtgcacccacggcatcaagcccgtggtgtccacccagctgctgctgaacggctccctggccgaggaggagatcatcatccgctccgagaacatcaccgacaacaccaaggtgatcatcgtgcagctgaacgagaccatcgagatcaactgcacccgccccaacaacaacacccgcaagtccatccgcatcggccccggccaggccttctacgccaccggcgacatcatcggcgacatccgccaggcccactgcaacgtgtcccgcaccaagtggaacgagatgctgcagaaggtgaaggcccagctgaagaagatcttcaacaagtccatcaccttcaactcctcctccggcggcgacctggagatcaccacccactccttcaactgccgcggcgagttcttctactgcaacacctccggcctgttcaacaactccctgctgaactccaccaactccaccatcaccctgccctgcaagatcaagcagatcgtgcgcatgtggcagcgcgtgggccaggccatgtacgccccccccatcgccggcaacatcacctgccgctccaacatcaccggcctgctgctgacccgcgacggcggcaacaacaacaccgagaccttccgccccggcggcggcgacatgcgcgacaactggcgctccgagctgtacaagtacaagatcgtgaagatcaagcccctgggcgtggcccccacccgcgcccgccgccgcgtggtggagcgcgagaagcgcgccgtgggcctgggcgccgtgctgctgggcttcctgggcgccgccggctccaccatgggcgccgcctccatcaccctgaccgtgcaggtgcgccagctgctgtccggcatcgtgcagcagcagtccaacctgctgcgcgccatcgaggcccagcagcacctgctgcagctgaccgtgtggggcatcaagcagctgcaggcccgcgtgctggccgtggagcgctacctgaaggaccagcagctgctgggcatctggggctgctccggcaagctgatctgcaccaccaacgtgccctggaacacctcctggtccaacaagtcctacaacgagatctgggacaacatgacctggatcgagtgggagcgcgagatctccaactacacccagcagatctactccctgatcgaggagtcccagaaccagcaggagaagaacgagcaggacctgctggccctggacaagtgggcctccctgtggaactggttcgacatcaccaagtggctgtggtacatcaagatcttcatcatgatcgtgggcggcctgatcggcctgcgcatcgtgttcgccgtgctgtccatcgtgaaccgcgtgcgccagggctactcccccctgtccttccagaccctgacccaccaccagcgcgagcccgaccgccccgagcgcatcgaggagggcggcggcgagcaggacaaggaccgctccatccgcctggtgtccggcttcctggccctggcctgggacgacctgcgctccctgtgcctgttctcctaccaccgcctgcgcgacttcatcctgatcgccgcccgcaccgtggagctgctgggccgctcctccctgaagggcctgcgcctgggctgggagggcctgaagtacctgtggaacctgctgctgtactggggccaggagctgaagaactccgccatcaacctgctggacaccatcgccatcgccgtggccaactggaccgaccgcgtgatcgaggtggcccagcgcgcctgccgcgccatcctgaacatcccccgccgcatccgccagggcctggagcgcgccctgctgtaa

SEQ ID NO: 92 - DNA, 2520 bp, Human immunodeficiency virus
acccgcgtgatggagacccagcgcaactacccctccctgtggcgctggggcaccctgatcctgggcatgctgctgatctgctccgccgccggcaacctgtgggtgaccgtgtactacggcgtgcccgtgtggaaggaggccaagaccaccctgttctgcgcctccgacgccaaggcctacgagaccgagaagcacaacgtgtgggccacccacgcctgcgtgcccaccgaccccaacccccaggagatggtgctggagaacgtgaccgagaacttcaacatgtgggagaacgacatggtggagcagatgcacaccgacatcatctccctgtgggaccagtccctgaagccctgcgtgaagctgacccccctgtgcgtgaccctggactgctccaacgtgaacaccaccaacgccaccaactcccgcttcaacatgcaggaggagctgaccaactgctccttcaacgtgaccaccgtgatccgcgacaagcagcagaaggtgcacgccctgttctaccgcctggacgtggtgcccatcgacgacaacaactcctaccagtaccgcctgatcaactgcaacacctccgtgatcacccaggcctgccccaaggtgtccttcgagcccatccccatccactactgcgcccccgccggcttcgccatcctgaagtgcaacaacaagaccttcaacggcaccggcccctgcaccaacgtgtccaccgtgcagtgcacccacggcatccgccccgtggtgtccacccagctgctgctgaacggctccctggccgaggagcaggtgatcatccgctccaagaacatctccgacaacaccaagaacatcatcgtgcagctgaacaagcccgtggagatcacctgcacccgccccaacaacaacacccgcaagtccatccacctgggccccggccaggccttctacgccaccggcgacatcatcggcgacatccgccaggcccactgcaacatctccggcaagaagtggaacaagaccctgcaccaggtggtgacccagctgggcaagtacttcgacaaccgcaccatcatcttcaagccccactccggcggcgacatggaggtgaccacccactccttcaactgccgcggcgagttcttctactgcaacacctccggcctgttcaactcctcctggaccaactccaccaacgacaccaagaacatcatcaccctgccctgccgcatcaagcagatcgtgaacatgtggcagcgcgtgggccaggccatgtacgccccccccatcaagggcaacatcacctgcgtgtccaacatcaccggcctgatcctgaccttcgacgagggcaacaacaccgtgaccttccgccccggcggcggcgacatgcgcgacaactggcgctccgagctgtacaagtacaaggtggtgaagatcgagcccctgggcgtggcccccaccgaggcccgccgccgcgtggtggagcgcgagaagcgcgccgtgggcatgggcgccttcttcctgggcttcctgggcgccgccggctccaccatgggcgccgcctccatcaccctgaccgtgcaggcccgccagctgctgtccggcatcgtgcagcagcagtccaacctgctgcgcgccatccaggcccagcagcacatgctgcagctgaccgtgtggggcatcaagcagctgcaggcccgcgtgctggccgtggagcgctacctgaaggaccagcagctgctgggcatctggggctgctccggcaagctgatctgcaccaccaacgtgccctggaactcctcctggtccaacaagtccctggacgagatctgggacaacatgacctggatggagtgggacaagcagatcaacaactacaccgaggagatctaccgcctgctggaggtgtcccagacccagcaggagaagaacgagcaggacctgctggccctggacaagtgggcctccctgtggaactggttctccatcaccaactggctgtggtacatcaagatcttcatcatgatcgtgggcggcctgatcggcctgcgcatcatcttcgccgtgctgtccatcgtgaaccgcgtgcgccagggctactcccccctgtccttccagaccctgatccccaacccccgcggccccgaccgccccgagggcatcgaggaggagggcggcgagcaggaccgcgaccgctccgtgcgcctggtgaacggcttcctgcccctggtgtgggacgacctgcgctccctgtgcctgttctcctaccgcctgctgcgcgacctgctgctgatcgtggtgcgcaccgtggagctgctgggccgccgcggccgcgaggccctgaagtacctgtggaacctgctgcagtactggggccaggagctgaagaactccgccatcaacctgctgaacaccaccgccatcgccgtggccgagggcaccgaccgcatcatcgagatcgtgcagcgcgcctggcgcgccatcctgcacatcccccgccgcatccgccagggcttcgagcgcaccctgctgtaa

SEQ ID NO: 93 - protein, 854 aa, Human immunodeficiency virus; identical to SEQ ID NO: 47

SEQ ID NO: 94 - protein, 844 aa, Human immunodeficiency virus
MRVMGIQKNYPLLWRWGMIIFWIMIICNAENLWVTVYYGVPVWRDAETTLFCASDAKAYDTEVHNVWATHACVPTDPNPQEIHLENVTENFNMWKNNMVEQMHEDIISLWDQSLKPCVKLTPLCVTLDCHNNITNSNTTNNNAGEIKNCSFNMTTELRDKKQKVYALFYRLDVVQINKNNSQYRLINCNTSAITQACPKVSFEPIPIHYCAPAGFAILKCNDKEFNGTGPCKNVSTVQCTHGIKPVVSTQLLLNGSLAEEEIVIRSENITNNAKTIIVQLVKPVKINCTRPNNNTRKSVRIGPGQTFYATGDIIGDIRQAHCNVSRTKWNNTLQQVATQLRKYFNKTIIFANPSGGDLEITTHSFNCGGEFFYCNTSELFNSTWNSTWNNTEKCITLQCRIKQIVNMWQKVGQAMYAPPIQGVIRCESNITGLLLTRDGGNNNSTNETFRPGGGDMRDNWRSELYKYKVVKIEPLGVAPTRAKRRVVEREKRAVGLGAVFLGFLGAAGSTMGAASITLTVQARQLLSGIVQQQSNLLRAIEAQQHLLKLTVWGIKQLQARVLALERYLKDQQLLGIWGCSGKLICTTTVPWNSSWSNKTYNDIWDNMTWLQWDKEISNYTDIIYNLIEESQNQQEKNEQDLLALDKWASLWNWFDITNWLWYIKIFIMIVGGLIGLRIVFAVLTIINRVRQGYSPLSFQTLTHHQREPDRPERIEEGGGEQDRDRSVRLVSGFLALAWDDLRSLCLFSYHRLRDFVLIAARTVELLGHSSLKGLRLGWEALKYLGNLLSYWGQELKNSAINLLDTIAIAVANWTDRVIEIGQRAGRAILNIPRRIRQGLERALL

SEQ ID NO: 95 - DNA, 2565 bp, Human immunodeficiency virus
atgcgcgtgaaggagacccagatgaactggcccaacctgtggaagtggggcaccctgatcctgggcctggtgatcatctgctccgcctccgacaacctgtgggtgaccgtgtactacggcgtgcccgtgtggcgcgacgccgacaccaccctgttctgcgcctccgacgccaaggcccacgagaccgaggtgcacaacgtgtgggccacccacgcctgcgtgcccaccgaccccaacccccaggagatccacctggagaacgtgaccgagaacttcaacatgtggaagaacaacatggtggagcagatgcaggaggacgtgatctccctgtgggaccagtccctgaagccctgcgtgaagctgacccccctgtgcgtgaccctgaactgcaccaacgccaacctgaccaacgtgaacaacatcaccaacgtgtccaacatcatcggcaacatcaccaacgaggtgcgcaactgctccttcaacatgaccaccgagctgcgcgacaagaagcagaaggtgcacgccctgttctacaagctggacatcgtgcagatcgaggacaacaactcctaccgcctgatcaactgcaacacctccgtgatcaagcaggcctgccccaagatctccttcgaccccatccccatccactactgcacccccgccggctacgccatcctgaagtgcaacgacaagaacttcaacggcaccggcccctgcaagaacgtgtcctccgtgcagtgcacccacggcatcaagcccgtggtgtccacccagctgctgctgaacggctccctggccgaggaggagatcatcatccgctccgagaacctgaccaacaacgccaagaccatcatcgtgcacctgaacaagtccgtggagatcaactgcacccgcccctccaacaacacccgcacctccatcaccatcggccccggccaggtgttctaccgcaccggcgacatcatcggcgacatccgcaaggcctactgcgagatcaacggcaccaagtggaacgaggtgctgaagcaggtgaccgagaagctgaaggagcacttcaacaacaagaccatcatcttccagcccccctccggcggcgacctggagatcaccatgcaccacttcaactgccgcggcgagttcttctactgcaacaccaccaagctgttcaacaacacctgcatcggcaacgagaccatggagggctgcaacggcaccatcatcctgccctgcaagatcaagcagatcatcaacatgtggcagggcgccggccaggccatgtacgccccccccatctccggccgcatcaactgcgtgtccaacatcaccggcatcctgctgacccgcgacggcggcgccaacaacaccaacgagaccttccgccccggcggcggcaacatcaaggacaactggcgctccgagctgtacaagtacaaggtggtgcagatcgagcccctgggcatcgcccccacccgcgccaagcgccgcgtggtggagcgcgagaagcgcgccgtgggcatcggcgccatgatcttcggcttcctgggcgccgccggctccaccatgggcgccgcctccatcaccctgaccgtgcaggcccgccagctgctgtccggcatcgtgcagcagcagtccaacctgctgcgcgccatcgaggcccagcagcacctgctgcagctgaccgtgtggggcatcaagcagctgcaggcccgcgtgctggccgtggagcgctacctgaaggaccagaagttcctgggcctgtggggctgctccggcaagatcatctgcaccaccgccgtgccctggaactccacctggtccaaccgctccttcgaggagatctggaacaacatgacctggatcgagtgggagcgcgagatctccaactacaccaaccagatctacgagatcctgaccgagtcccagaaccagcaggaccgcaacgagaaggacctgctggagctggacaagtgggcctccctgtggaactggttcgacatcaccaactggctgtggtacatcaagatcttcatcatgatcgtgggcggcctgatcggcctgcgcatcatcttcgccgtgctgtccatcgtgaaccgcgtgcgccagggctactcccccctgtccttccagacccccacccaccaccagcgcgagcccgaccgccccgagcgcatcgaggagggcggcggcgagcagggccgcgaccgctccgtgcgcctggtgtccggcttcctggccctggcctgggacgacctgcgctccctgtgcctgttctcctaccaccgcctgcgcgacttcatcctgatcgccgcccgcaccgtggagctgctgggccactcctccctgaagggcctgcgccgcggctgggagggcctgaagtacctgggcaacctgctgctgtactggggccaggagctgaagatctccgccatctccctgctggacgccaccgccatcgccgtggccggctggaccgaccgcgtgatcgaggtggcccagggcgcctggcgcgccatcctgcacatcccccgccgcatccgccagggcctggagcgcgccctgctgtaa

SEQ ID NO: 96 - DNA, 2535 bp, Human immunodeficiency virus
atgcgcgtgatgggcatccagaagaactaccccctgctgtggcgctggggcatgatcatcttctggatcatgatcatctgcaacgccgagaacctgtgggtgaccgtgtactacggcgtgcccgtgtggcgcgacgccgagaccaccctgttctgcgcctccgacgccaaggcctacgacaccgaggtgcacaacgtgtgggccacccacgcctgcgtgcccaccgaccccaacccccaggagatccacctggagaacgtgaccgagaacttcaacatgtggaagaacaacatggtggagcagatgcacgaggacatcatctccctgtgggaccagtccctgaagccctgcgtgaagctgacccccctgtgcgtgaccctggactgccacaacaacatcaccaactccaacaccaccaacaacaacgccggcgagatcaagaactgctccttcaacatgaccaccgagctgcgcgacaagaagcagaaggtgtacgccctgttctaccgcctggacgtggtgcagatcaacaagaacaactcccagtaccgcctgatcaactgcaacacctccgccatcacccaggcctgccccaaggtgtccttcgagcccatccccatccactactgcgcccccgccggcttcgccatcctgaagtgcaacgacaaggagttcaacggcaccggcccctgcaagaacgtgtccaccgtgcagtgcacccacggcatcaagcccgtggtgtccacccagctgctgctgaacggctccctggccgaggaggagatcgtgatccgctccgagaacatcaccaacaacgccaagaccatcatcgtgcagctggtgaagcccgtgaagatcaactgcacccgccccaacaacaacacccgcaagtccgtgcgcatcggccccggccagaccttctacgccaccggcgacatcatcggcgacatccgccaggcccactgcaacgtgtcccgcaccaagtggaacaacaccctgcagcaggtggccacccagctgcgcaagtacttcaacaagaccatcatcttcgccaacccctccggcggcgacctggagatcaccacccactccttcaactgcggcggcgagttcttctactgcaacacctccgagctgttcaactccacctggaactccacctggaacaacaccgagaagtgcatcaccctgcagtgccgcatcaagcagatcgtgaacatgtggcagaaggtgggccaggccatgtacgccccccccatccagggcgtgatccgctgcgagtccaacatcaccggcctgctgctgacccgcgacggcggcaacaacaactccaccaacgagaccttccgccccggcggcggcgacatgcgcgacaactggcgctccgagctgtacaagtacaaggtggtgaagatcgagcccctgggcgtggcccccacccgcgccaagcgccgcgtggtggagcgcgagaagcgcgccgtgggcctgggcgccgtgttcctgggcttcctgggcgccgccggctccaccatgggcgccgcctccatcaccctgaccgtgcaggcccgccagctgctgtccggcatcgtgcagcagcagtccaacctgctgcgcgccatcgaggcccagcagcacctgctgaagctgaccgtgtggggcatcaagcagctgcaggcccgcgtgctggccctggagcgctacctgaaggaccagcagctgctgggcatctggggctgctccggcaagctgatctgcaccaccaccgtgccctggaactcctcctggtccaacaagacctacaacgacatctgggacaacatgacctggctgcagtgggacaaggagatctccaactacaccgacatcatctacaacctgatcgaggagtcccagaaccagcaggagaagaacgagcaggacctgctggccctggacaagtgggcctccctgtggaactggttcgacatcaccaactggctgtggtacatcaagatcttcatcatgatcgtgggcggcctgatcggcctgcgcatcgtgttcgccgtgctgaccatcatcaaccgcgtgcgccagggctactcccccctgtccttccagaccctgacccaccaccagcgcgagcccgaccgccccgagcgcatcgaggagggcggcggcgagcaggaccgcgaccgctccgtgcgcctggtgtccggcttcctggccctggcctgggacgacctgcgctccctgtgcctgttctcctaccaccgcctgcgcgacttcgtgctgatcgccgcccgcaccgtggagctgctgggccactcctccctgaagggcctgcgcctgggctgggaggccctgaagtacctgggcaacctgctgtcctactggggccaggagctgaagaactccgccatcaacctgctggacaccatcgccatcgccgtggccaactggaccgaccgcgtgatcgagatcggccagcgcgccggccgcgccatcctgaacatcccccgccgcatccgccagggcctggagcgcgccctgctgtaa

SEQ ID NO: 97 - protein, 840 aa, Human immunodeficiency virus
MRVKEIRKHLWRWGTLFLGMLMICSATENLWVTVYYGVPVWKEATTTLFCASDAKAYSKEVHNVWATYACVPTDPSPQEIPLENVTENFNMGKNNMVEQMHEDIISLWDQSLKPCVKLTPLCVTLNCTDLKKNVTSTNTSSIKMMEMKNCSFNITTDLRDKVKKEYALFYKLDVVQIDNDSYRLISCNTSVVTQACPKISFEPIPIHYCAPAGFAILKCNDKKFNGTGPCTNVSTVQCTHGIKPVVSTQLLLNGSLAEEEVVIRSVNFTDNTKTIIVQLKEPVEINCTRPNNNTRKGIHIGPGRAFYATGDIIGDIRQAHCNISITKWNNTLKQIVIKLRKQFGNKTIVFNQSSGGDPEIVMHSFNCGGEFFYCNTTKLFNSTWNGTEELNNTEGDIVTLPCRIKQIINMWQEVGKAMYAPPIAGQIRCSSNITGLLLTRDGGNQSNVTEIFRPGGGDMRDNWRSELYKYKVVKIEPLGVAPTKAKRRVVQREKRAVGIGAVFLGFLGAAGSTMGAASITLTVQARQLLSGIVQQQNNLLRAIEAQQHLLQLTVWGIKQLQARVLAVERYLKDQQLLGIWGCSGKLICTTAVPWNTSWSNKSLDEIWNNMTWMEWEREINNYTGLIYNLIEESQNQQEKNEQEILALDKWASLWNWFDISKWLWYIKIFIMIVGGLVGLRIIFAVLSIVNRVRQGYSPLSFQTRLPTQRGPDRPEGIEEEGGERDRDTSIRLVNGFLALIWDDLRSLCLFIYHHLRDLLLIAARIVELLGRRGWEALKYWWNLLQYWIQELKSSAINLIDTIAIAVAGWTDRVIEIGQRFCRAIRNIPRRIRQGAEKALQ

SEQ ID NO: 98 - protein, 848 aa, Human immunodeficiency virus
MRVMGIQRNYPHLWEWGTLILGLVIICSASKNLWVTVYYGVPVWRDAETTPFCASDAKAYDKEVHNIWATHACVPTDPNPQEIALKNVTENFNMWKNNMVEQMHEDIISLWDEGLKPCVKLTPLCVALNCSNATINNSTKTNSTEEIKNCSFNITTEIRDKKKKEYALFYRLDIVPINDSANNNSINSEYMLINCNASTIKQACPKVTFEPIPIHYCAPAGFAILKCNDKNFTGLGPCTNVSSVQCTHGIKPVVSTQLLLNGSLATEGVVIRSKNFTDNTKNIIVQLAKAVKINCTRPNNNTRKSVHIGPGQTWYATGEIIGDIRQAHCNISGNDWNETLQKIVEELRKHFPNKTIIFAPSAGGDLEITTHSFNCGGEFFYCNTSELFNSTYMNSTNSTTINKTITLPCRIKQIVSMWQEVGQAMYAPPIAGSINCSSDITGIILTRDGGNNNTNNETFRPGGGDMRDNWRSELYKYKVVKIEPVGVAPTRARRRVVQREKRAVGIGAVFLGFLGAAGSTMGAASITLTVQARQLLSGIVQQQSNLLRAIEAQQHLLRLTVWGIKQLQARVLALESYLKDQQLLGIWGCSGKLICTTNVPWNSSWSNKSYNDIWDNMTWLQWDKEINNYTQIIYELLEESQNQQEKNEQDLLALDKWANLWNWFNISNWLWYIKIFIMIVGGLIGLRIIFAVLSIVNRVRQGYSPLSLQTLIPTTQRGPDRPEGTEEEGGEQDRSRSIRLVNGFLPLIWDDLRNLCLFSYRHLRNLLLIVARTVELLGIRGWEALKYLWNLLLYWGQELRNSAINLLDTTAIAVAEGTDRIIEAVQRACRAIRNIPRRIRQGLERALL

SEQ ID NO: 99 - DNA, 2523 bp, Human immunodeficiency virus
atgcgcgtgaaggagatccgcaagcacctgtggcgctggggcaccctgttcctgggcatgctgatgatctgctccgccaccgagaacctgtgggtgaccgtgtactacggcgtgcccgtgtggaaggaggccaccaccaccctgttctgcgcctccgacgccaaggcctactccaaggaggtgcacaacgtgtgggccacctacgcctgcgtgcccaccgacccctccccccaggagatccccctggagaacgtgaccgagaacttcaacatgggcaagaacaacatggtggagcagatgcacgaggacatcatctccctgtgggaccagtccctgaagccctgcgtgaagctgacccccctgtgcgtgaccctgaactgcaccgacctgaagaagaacgtgacctccaccaacacctcctccatcaagatgatggagatgaagaactgctccttcaacatcaccaccgacctgcgcgacaaggtgaagaaggagtacgccctgttctacaagctggacgtggtgcagatcgacaacgactcctaccgcctgatctcctgcaacacctccgtggtgacccaggcctgccccaagatctccttcgagcccatccccatccactactgcgcccccgccggcttcgccatcctgaagtgcaacgacaagaagttcaacggcaccggcccctgcaccaacgtgtccaccgtgcagtgcacccacggcatcaagcccgtggtgtccacccagctgctgctgaacggctccctggccgaggaggaggtggtgatccgctccgtgaacttcaccgacaacaccaagaccatcatcgtgcagctgaaggagcccgtggagatcaactgcacccgccccaacaacaacacccgcaagggcatccacatcggccccggccgcgccttctacgccaccggcgacatcatcggcgacatccgccaggcccactgcaacatctccatcaccaagtggaacaacaccctgaagcagatcgtgatcaagctgcgcaagcagttcggcaacaagaccatcgtgttcaaccagtcctccggcggcgaccccgagatcgtgatgcactccttcaactgcggcggcgagttcttctactgcaacaccaccaagctgttcaactccacctggaacggcaccgaggagctgaacaacaccgagggcgacatcgtgaccctgccctgccgcatcaagcagatcatcaacatgtggcaggaggtgggcaaggccatgtacgccccccccatcgccggccagatccgctgctcctccaacatcaccggcctgctgctgacccgcgacggcggcaaccagtccaacgtgaccgagatcttccgccccggcggcggcgacatgcgcgacaactggcgctccgagctgtacaagtacaaggtggtgaagatcgagcccctgggcgtggcccccaccaaggccaagcgccgcgtggtgcagcgcgagaagcgcgccgtgggcatcggcgccgtgttcctgggcttcctgggcgccgccggctccaccatgggcgccgcctccatcaccctgaccgtgcaggcccgccagctgctgtccggcatcgtgcagcagcagaacaacctgctgcgcgccatcgaggcccagcagcacctgctgcagctgaccgtgtggggcatcaagcagctgcaggcccgcgtgctggccgtggagcgctacctgaaggaccagcagctgctgggcatctggggctgctccggcaagctgatctgcaccaccgccgtgccctggaacacctcctggtccaacaagtccctggacgagatctggaacaacatgacctggatggagtgggagcgcgagatcaacaactacaccggcctgatctacaacctgatcgaggagtcccagaaccagcaggagaagaacgagcaggagatcctggccctggacaagtgggcctccctgtggaactggttcgacatctccaagtggctgtggtacatcaagatcttcatcatgatcgtgggcggcctggtgggcctgcgcatcatcttcgccgtgctgtccatcgtgaaccgcgtgcgccagggctactcccccctgtccttccagacccgcctgcccacccagcgcggccccgaccgccccgagggcatcgaggaggagggcggcgagcgcgaccgcgacacctccatccgcctggtgaacggcttcctggccctgatctgggacgacctgcgctccctgtgcctgttcatctaccaccacctgcgcgacctgctgctgatcgccgcccgcatcgtggagctgctgggccgccgcggctgggaggccctgaagtactggtggaacctgctgcagtactggatccaggagctgaagtcctccgccatcaacctgatcgacaccatcgccatcgccgtggccggctggaccgaccgcgtgatcgagatcggccagcgcttctgccgcgccatccgcaacatcccccgccgcatccgccagggcgccgagaaggccctgcagtaa

SEQ ID NO: 100 - DNA, 2547 bp, Human immunodeficiency virus
atgcgcgtgatgggcatccagcgcaactacccccacctgtgggagtggggcaccctgatcctgggcctggtgatcatctgctccgcctccaagaacctgtgggtgaccgtgtactacggcgtgcccgtgtggcgcgacgccgagaccacccccttctgcgcctccgacgccaaggcctacgacaaggaggtgcacaacatctgggccacccacgcctgcgtgcccaccgaccccaacccccaggagatcgccctgaagaacgtgaccgagaacttcaacatgtggaagaacaacatggtggagcagatgcacgaggacatcatctccctgtgggacgagggcctgaagccctgcgtgaagctgacccccctgtgcgtggccctgaactgctccaacgccaccatcaacaactccaccaagaccaactccaccgaggagatcaagaactgctccttcaacatcaccaccgagatccgcgacaagaagaagaaggagtacgccctgttctaccgcctggacatcgtgcccatcaacgactccgccaacaacaactccatcaactccgagtacatgctgatcaactgcaacgcctccaccatcaagcaggcctgccccaaggtgaccttcgagcccatccccatccactactgcgcccccgccggcttcgccatcctgaagtgcaacgacaagaacttcaccggcctgggcccctgcaccaacgtgtcctccgtgcagtgcacccacggcatcaagcccgtggtgtccacccagctgctgctgaacggctccctggccaccgagggcgtggtgatccgctccaagaacttcaccgacaacaccaagaacatcatcgtgcagctggccaaggccgtgaagatcaactgcacccgccccaacaacaacacccgcaagtccgtgcacatcggccccggccagacctggtacgccaccggcgagatcatcggcgacatccgccaggcccactgcaacatctccggcaacgactggaacgagaccctgcagaagatcgtggaggagctgcgcaagcacttccccaacaagaccatcatcttcgccccctccgccggcggcgacctggagatcaccacccactccttcaactgcggcggcgagttcttctactgcaacacctccgagctgttcaactccacctacatgaactccaccaactccaccaccatcaacaagaccatcaccctgccctgccgcatcaagcagatcgtgtccatgtggcaggaggtgggccaggccatgtacgccccccccatcgccggctccatcaactgctcctccgacatcaccggcatcatcctgacccgcgacggcggcaacaacaacaccaacaacgagaccttccgccccggcggcggcgacatgcgcgacaactggcgctccgagctgtacaagtacaaggtggtgaagatcgagcccgtgggcgtggcccccacccgcgcccgccgccgcgtggtgcagcgcgagaagcgcgccgtgggcatcggcgccgtgttcctgggcttcctgggcgccgccggctccaccatgggcgccgcctccatcaccctgaccgtgcaggcccgccagctgctgtccggcatcgtgcagcagcagtccaacctgctgcgcgccatcgaggcccagcagcacctgctgcgcctgaccgtgtggggcatcaagcagctgcaggcccgcgtgctggccctggagtcctacctgaaggaccagcagctgctgggcatctggggctgctccggcaagctgatctgcaccaccaacgtgccctggaactcctcctggtccaacaagtcctacaacgacatctgggacaacatgacctggctgcagtgggacaaggagatcaacaactacacccagatcatctacgagctgctggaggagtcccagaaccagcaggagaagaacgagcaggacctgctggccctggacaagtgggccaacctgtggaactggttcaacatctccaactggctgtggtacatcaagatcttcatcatgatcgtgggcggcctgatcggcctgcgcatcatcttcgccgtgctgtccatcgtgaaccgcgtgcgccagggctactcccccctgtccctgcagaccctgatccccaccacccagcgcggccccgaccgccccgagggcaccgaggaggagggcggcgagcaggaccgctcccgctccatccgcctggtgaacggcttcctgcccctgatctgggacgacctgcgcaacctgtgcctgttctcctaccgccacctgcgcaacctgctgctgatcgtggcccgcaccgtggagctgctgggcatccgcggctgggaggccctgaagtacctgtggaacctgctgctgtactggggccaggagctgcgcaactccgccatcaacctgctggacaccaccgccatcgccgtggccgagggcaccgaccgcatcatcgaggccgtgcagcgcgcctgccgcgccatccgcaacatcccccgccgcatccgccagggcctggagcgcgccctgctgtaa

SEQ ID NO: 101 - protein, 832 aa, Human immunodeficiency virus
MRVKGIQKNWQHLWKWGTLILGLVIICSASNNMWVTVYYGVPAWEDADTILFCASDAKAYSAEKHNVWATHACVPTDPNPQEIALENVTENFNMWKNHMVEQMHEDIISLWDESLKPCVKLTPLCVTLNCTNVTKNNNTKIMGREEIKNCSFNVTTEIRDKKKKEYALFYRLDVVPIDDNNNSYRLINCNASTIKQACPKVSFEPIPIHYCAPAGFAILKCRDKNFNGTGPCKNVSTVQCTHGIKPVVSTQLLLNGSLAEEEIIIKSENLTDNTKTIIVQLNKSVEIRCTRPNNNTRKSISFGPGQAFYATGDIIGDIRQAHCNVSRTDWNNMLQNVTAKLKELFNKNITFNSSAGGDLEITTHSFNCGGEFFYCNTSQLFNSTRPNETNTITLPCKIKQIVRMWQRVGQAMYAPPIAGNITCTSNITGLLLTRDGNNNDSETFRPGGGDMRDNWRSELYKYKVVKIKPLGIAPTRARRRVVGREKRAVGLGAVFLGFLGTAGSTMGAASITLTVQVRQLLSGIVQQQSNLLRAIEAQQHLLQLTVWGIKQLQARVLAVERYLKDQQLLGIWGCSGKLICPTNVPWNASWSNKTYNEIWDNMTWIEWDREINNYTQQIYSLIEESQNQQEKNEQDLLALDKWASLWSWFDISNWLWYIKIFIMIVGGLIGLRIVFAVLSIVNRVRQGYSPLSLQTLIPNPTGADRPGEIEEGGGEQGRTRSIRLVNGFLALAWDDLRSLCLFSYHRLRDFVLIAARTVETLGHRGWEILKYLGNLVCYWGQELKNSAISLLDTTAIAVANWTDRVIEVVQRVFRAFLNIPRRIRQGFERALL

SEQ ID NO: 102 - protein, 858 aa, Human immunodeficiency virus
MRVRGTRRNYQQWWIWGVLGFWMLMICNVEGNLWVTVYYGVPVWKEAKTTLFCASDAKAYETEVHNVWATHACVPTDPNPQEIVMENVTENFNMWNNDMVNQMHEDVISLWDQSLKPCVKLTPLCVTLECTNVSSNGNGTYNETYNESVKEIKNCSFNATTLLRDRKKTVYALFYRLDIVPLNDENSGKNSSEYYRLINCNTSAITQACPKVTFDPIPIHYCTPAGYAILKCNDKKFNGTGQCHNVSTVQCTHGIKPVVSTQLLLNGSLAEREIIIRSENLTNNVKTIIVHLNQSVEIVCTRPNNNTRKSIRIGPGQTFYATGDIIGDIRQAHCNISKDKWYETLQRVSKKLAEHFPNKTIKFASSSGGDLEITTHSFNCRGEFFYCNTSGLFNGTYMNGTNNSSSIITIPCRIKQIINMWQEVGRAMYAPPIEGNITCKSNITGLLLVRDGGRTESNNTEIFRPGGGDMRNNWRNELYKYKVVEIKPLGVAPTAAKRRVVEREKRAVGLGAVFLGFLGAAGSTMGAASITLTVQARQLLSGIVQQQSNLLRAIEAQQHMLQLTVWGIKQLQTRVLAIERYLKDQQLLGIWGCSGKLICTTAVPWNSSWSNKSQQEIWDNMTWMQWDKEISNYTNTIYRLLEDSQNQQERNEKDLLALDSWKNLWSWFDITNWLWYIKIFIMIVGGLIGLRIIFAVLSIVNRVRQGYSPLSFQILTPNPGGPGRLGRIEEEGGEQDKTRSIRLVNGFLALAWDDLRNLCLFSYHRLRDFILLTARGVELLGRNSLRGLQRGWEALKYLGSLVQYWGLELKKSTISLVDTIAIAVAEGTDRIINIVQGICRAIHNIPRRIRQGFEAALQ

SEQ ID NO: 103 - DNA, 2499 bp, Human immunodeficiency virus
atgcgcgtgaagggcatccagaagaactggcagcacctgtggaagtggggcaccctgatcctgggcctggtgatcatctgctccgcctccaacaacatgtgggtgaccgtgtactacggcgtgcccgcctgggaggacgccgacaccatcctgttctgcgcctccgacgccaaggcctactccgccgagaagcacaacgtgtgggccacccacgcctgcgtgcccaccgaccccaacccccaggagatcgccctggagaacgtgaccgagaacttcaacatgtggaagaaccacatggtggagcagatgcacgaggacatcatctccctgtgggacgagtccctgaagccctgcgtgaagctgacccccctgtgcgtgaccctgaactgcaccaacgtgaccaagaacaacaacaccaagatcatgggccgcgaggagatcaagaactgctccttcaacgtgaccaccgagatccgcgacaagaagaagaaggagtacgccctgttctaccgcctggacgtggtgcccatcgacgacaacaacaactcctaccgcctgatcaactgcaacgcctccaccatcaagcaggcctgccccaaggtgtccttcgagcccatccccatccactactgcgcccccgccggcttcgccatcctgaagtgccgcgacaagaacttcaacggcaccggcccctgcaagaacgtgtccaccgtgcagtgcacccacggcatcaagcccgtggtgtccacccagctgctgctgaacggctccctggccgaggaggagatcatcatcaagtccgagaacctgaccgacaacaccaagaccatcatcgtgcagctgaacaagtccgtggagatccgctgcacccgccccaacaacaacacccgcaagtccatctccttcggccccggccaggccttctacgccaccggcgacatcatcggcgacatccgccaggcccactgcaacgtgtcccgcaccgactggaacaacatgctgcagaacgtgaccgccaagctgaaggagctgttcaacaagaacatcaccttcaactcctccgccggcggcgacctggagatcaccacccactccttcaactgcggcggcgagttcttctactgcaacacctcccagctgttcaactccacccgccccaacgagaccaacaccatcaccctgccctgcaagatcaagcagatcgtgcgcatgtggcagcgcgtgggccaggccatgtacgccccccccatcgccggcaacatcacctgcacctccaacatcaccggcctgctgctgacccgcgacggcaacaacaacgactccgagaccttccgccccggcggcggcgacatgcgcgacaactggcgctccgagctgtacaagtacaaggtggtgaagatcaagcccctgggcatcgcccccacccgcgcccgccgccgcgtggtgggccgcgagaagcgcgccgtgggcctgggcgccgtgttcctgggcttcctgggcaccgccggctccaccatgggcgccgcctccatcaccctgaccgtgcaggtgcgccagctgctgtccggcatcgtgcagcagcagtccaacctgctgcgcgccatcgaggcccagcagcacctgctgcagctgaccgtgtggggcatcaagcagctgcaggcccgcgtgctggccgtggagcgctacctgaaggaccagcagctgctgggcatctggggctgctccggcaagctgatctgccccaccaacgtgccctggaacgcctcctggtccaacaagacctacaacgagatctgggacaacatgacctggatcgagtgggaccgcgagatcaacaactacacccagcagatctactccctgatcgaggagtcccagaaccagcaggagaagaacgagcaggacctgctggccctggacaagtgggcctccctgtggtcctggttcgacatctccaactggctgtggtacatcaagatcttcatcatgatcgtgggcggcctgatcggcctgcgcatcgtgttcgccgtgctgtccatcgtgaaccgcgtgcgccagggctactcccccctgtccctgcagaccctgatccccaaccccaccggcgccgaccgccccggcgagatcgaggagggcggcggcgagcagggccgcacccgctccatccgcctggtgaacggcttcctggccctggcctgggacgacctgcgctccctgtgcctgttctcctaccaccgcctgcgcgacttcgtgctgatcgccgcccgcaccgtggagaccctgggccaccgcggctgggagatcctgaagtacctgggcaacctggtgtgctactggggccaggagctgaagaactccgccatctccctgctggacaccaccgccatcgccgtggccaactggaccgaccgcgtgatcgaggtggtgcagcgcgtgttccgcgccttcctgaacatcccccgccgcatccgccagggcttcgagcgcgccctgctgtaa

SEQ ID NO: 104 - DNA, 2577 bp, Human immunodeficiency virus
atgcgcgtgcgcggcacccgccgcaactaccagcagtggtggatctggggcgtgctgggcttctggatgctgatgatctgcaacgtggagggcaacctgtgggtgaccgtgtactacggcgtgcccgtgtggaaggaggccaagaccaccctgttctgcgcctccgacgccaaggcctacgagaccgaggtgcacaacgtgtgggccacccacgcctgcgtgcccaccgaccccaacccccaggagatcgtgatggagaacgtgaccgagaacttcaacatgtggaacaacgacatggtgaaccagatgcacgaggacgtgatctccctgtgggaccagtccctgaagccctgcgtgaagctgacccccctgtgcgtgaccctggagtgcaccaacgtgtcctccaacggcaacggcacctacaacgagacctacaacgagtccgtgaaggagatcaagaactgctccttcaacgccaccaccctgctgcgcgaccgcaagaagaccgtgtacgccctgttctaccgcctggacatcgtgcccctgaacgacgagaactccggcaagaactcctccgagtactaccgcctgatcaactgcaacacctccgccatcacccaggcctgccccaaggtgaccttcgaccccatccccatccactactgcacccccgccggctacgccatcctgaagtgcaacgacaagaagttcaacggcaccggccagtgccacaacgtgtccaccgtgcagtgcacccacggcatcaagcccgtggtgtccacccagctgctgctgaacggctccctggccgagcgcgagatcatcatccgctccgagaacctgaccaacaacgtgaagaccatcatcgtgcacctgaaccagtccgtggagatcgtgtgcacccgccccaacaacaacacccgcaagtccatccgcatcggccccggccagaccttctacgccaccggcgacatcatcggcgacatccgccaggcccactgcaacatctccaaggacaagtggtacgagaccctgcagcgcgtgtccaagaagctggccgagcacttccccaacaagaccatcaagttcgcctcctcctccggcggcgacctggagatcaccacccactccttcaactgccgcggcgagttcttctactgcaacacctccggcctgttcaacggcacctacatgaacggcaccaacaactcctcctccatcatcaccatcccctgccgcatcaagcagatcatcaacatgtggcaggaggtgggccgcgccatgtacgccccccccatcgagggcaacatcacctgcaagtccaacatcaccggcctgctgctggtgcgcgacggcggccgcaccgagtccaacaacaccgagatcttccgccccggcggcggcgacatgcgcaacaactggcgcaacgagctgtacaagtacaaggtggtggagatcaagcccctgggcgtggcccccaccgccgccaagcgccgcgtggtggagcgcgagaagcgcgccgtgggcctgggcgccgtgttcctgggcttcctgggcgccgccggctccaccatgggcgccgcctccatcaccctgaccgtgcaggcccgccagctgctgtccggcatcgtgcagcagcagtccaacctgctgcgcgccatcgaggcccagcagcacatgctgcagctgaccgtgtggggcatcaagcagctgcagacccgcgtgctggccatcgagcgctacctgaaggaccagcagctgctgggcatctggggctgctccggcaagctgatctgcaccaccgccgtgccctggaactcctcctggtccaacaagtcccagcaggagatctgggacaacatgacctggatgcagtgggacaaggagatctccaactacaccaacaccatctaccgcctgctggaggactcccagaaccagcaggagcgcaacgagaaggacctgctggccctggactcctggaagaacctgtggtcctggttcgacatcaccaactggctgtggtacatcaagatcttcatcatgatcgtgggcggcctgatcggcctgcgcatcatcttcgccgtgctgtccatcgtgaaccgcgtgcgccagggctactcccccctgtccttccagatcctgacccccaaccccggcggccccggccgcctgggccgcatcgaggaggagggcggcgagcaggacaagacccgctccatccgcctggtgaacggcttcctggccctggcctgggacgacctgcgcaacctgtgcctgttctcctaccaccgcctgcgcgacttcatcctgctgaccgcccgcggcgtggagctgctgggccgcaactccctgcgcggcctgcagcgcggctgggaggccctgaagtacctgggctccctggtgcagtactggggcctggagctgaagaagtccaccatctccctggtggacaccatcgccatcgccgtggccgagggcaccgaccgcatcatcaacatcgtgcagggcatctgccgcgccatccacaacatcccccgccgcatccgccagggcttcgaggccgccctgcagtaa

SEQ ID NO: 105 - protein, 837 aa, Human immunodeficiency virus
MRVMGIQRNCQQWWIWGILGFWMLMICNATGNLWVTVYYGVPVWKETTTTLFCASDAKAYKAEAHNIWATHACVPTDPNPQEIVLENVTENFNMWKNGMVDQMHEDIISLWDQGLKPCVKLTPLCVTLNCSDVNATNSATNTVVAGMKNCSFNITTEIRDKKKQEYALFYKLDVVQIDGSNTSYRLINCNTSAITQACPKVTFEPIPIHYCAPAGFAILKCNDKKFNGTGPCKNVSTVQCTHGIKPVVSTQLLLNGSLAEEEIIIRSENLTDNAKTIIVQLNESVTINCTRPNNNTRKSIRIGPGQTFYATGDIIGNIRQAYCNISGTEWNKTLQQVAKKLGDLLNKTTIIFKPSSGGDPEITTHTFNCGGEFFYCNTSKLFNSSWTSNNTGNTSTITLPCRIKQIINMWQGVGKAIYAPPIAGLINCSSNITGLLLTRDGGANNSETFRPGGGDMRDNWRSELYKYKVVKIEPLGLAPTKAKRRVVEREKRAIGLGAVFLGFLGAAGSTMGAASLTLTVQARQLLSGIVQQQNNLLRAIEAQQHLLQLTVWGIKQLQARVLAVESYLKDQQLLGIWGCSGKHICTTNVPWNSSWSNKSLEEIWDNMTWMEWEREIDNYTGLIYSLIEESQNQQEKNEQELLQLDKWASLWNWFSITNWLWYIKIFIMIVGGLIGLRIVFAVLSLVNRVRQGYSPLSFQTLLPAPRGPDRPEGIEEEGGEQGRGRSIRLVNGFSALIWDDLRNLCLFSYHRLRDLILIATRIVELLGRRGWEAIKYLWNLLQYWIQELKNSAISLLDTTAIAVAEGTDRAIEIVQRAVRAVLNIPTRIRQGLERALL

SEQ ID NO: 106 - protein, 839 aa, Human immunodeficiency virus
MRVKETQRNWHNLWRWGLMIFGMLMICNATENLWVTVYYGVPVWKDADTTLFCASDAKAYSTEKHNVWATHACVPTDPNPQEIPLENVTENFNMWKNNMVEQMHEDIISLWDESLKPCVKLTPLCVTLNCTDVKNATNTTVEAAEIKNCSFNITTEIKDKKKKEYALFYKLDVVPINDNNNSIYRLINCNVSTVKQACPKVTFEPIPIHYCAPAGFAILKCNDKKFNGTGPCKNVSTVQCTHGIKPVVSTQLLLNGSLAEGEVRIRSENFTNNAKTIIVQLNSSVRINCTRPNNNTRKSIHIGPGQAFYATGDIIGDIRQAHCNISRAEWNNTLQQVAKQLRENFNKTIIFNNPSGGDLEITTHSFNCGGEFFYCNTSRLFNSTWNNDTRNDTKQMHITLPCRIKQIVNMWQRVGQAMYAPPIQGKIRCNSNITGLLLTRDGGNNNTNETFRPTGGDMRDNWRSELYKYKVVEIKPLGVAPTRAKRRVVEREKRAVGIGAVLLGFLGAAGSTMGAASITLTVQARQLLSGIVQQQSNLLKAIEAQQHLLKLTVWGIKQLQARVLAVERYLKDQQLLGIWGCSGKLICTTNVPWNFSWSNKSYDEIWDNMTWIEWEREINNYTQTIYTLLEESQNQQEKNEQDLLALDKWASLWNWFDISNWLWYIKIFIMIVGGLIGLRIIFAVLSIVNRCRQGYSPLSFQTLTPNHKEADRPGGIEEGGGEQDRTRSIRLVSGFLALAWDDLRNLCLFSYHRLRDFILIAARIVETLGRRGWEILKYLGNLAQYWGQELKNSAISLLNATAIAVAEGTDRIIEVVHRVLRAILHIPRRIRQGFERALL

SEQ ID NO: 107 - DNA, 2514 bp, Human immunodeficiency virus
atgcgcgtgatgggcatccagcgcaactgccagcagtggtggatctggggcatcctgggcttctggatgctgatgatctgcaacgccaccggcaacctgtgggtgaccgtgtactacggcgtgcccgtgtggaaggagaccaccaccaccctgttctgcgcctccgacgccaaggcctacaaggccgaggcccacaacatctgggccacccacgcctgcgtgcccaccgaccccaacccccaggagatcgtgctggagaacgtgaccgagaacttcaacatgtggaagaacggcatggtggaccagatgcacgaggacatcatctccctgtgggaccagggcctgaagccctgcgtgaagctgacccccctgtgcgtgaccctgaactgctccgacgtgaacgccaccaactccgccaccaacaccgtggtggccggcatgaagaactgctccttcaacatcaccaccgagatccgcgacaagaagaagcaggagtacgccctgttctacaagctggacgtggtgcagatcgacggctccaacacctcctaccgcctgatcaactgcaacacctccgccatcacccaggcctgccccaaggtgaccttcgagcccatccccatccactactgcgcccccgccggcttcgccatcctgaagtgcaacgacaagaagttcaacggcaccggcccctgcaagaacgtgtccaccgtgcagtgcacccacggcatcaagcccgtggtgtccacccagctgctgctgaacggctccctggccgaggaggagatcatcatccgctccgagaacctgaccgacaacgccaagaccatcatcgtgcagctgaacgagtccgtgaccatcaactgcacccgccccaacaacaacacccgcaagtccatccgcatcggccccggccagaccttctacgccaccggcgacatcatcggcaacatccgccaggcctactgcaacatctccggcaccgagtggaacaagaccctgcagcaggtggccaagaagctgggcgacctgctgaacaagaccaccatcatcttcaagccctcctccggcggcgaccccgagatcaccacccacaccttcaactgcggcggcgagttcttctactgcaacacctccaagctgttcaactcctcctggacctccaacaacaccggcaacacctccaccatcaccctgccctgccgcatcaagcagatcatcaacatgtggcagggcgtgggcaaggccatctacgccccccccatcgccggcctgatcaactgctcctccaacatcaccggcctgctgctgacccgcgacggcggcgccaacaactccgagaccttccgccccggcggcggcgacatgcgcgacaactggcgctccgagctgtacaagtacaaggtggtgaagatcgagcccctgggcctggcccccaccaaggccaagcgccgcgtggtggagcgcgagaagcgcgccatcggcctgggcgccgtgttcctgggcttcctgggcgccgccggctccaccatgggcgccgcctccctgaccctgaccgtgcaggcccgccagctgctgtccggcatcgtgcagcagcagaacaacctgctgcgcgccatcgaggcccagcagcacctgctgcagctgaccgtgtggggcatcaagcagctgcaggcccgcgtgctggccgtggagtcctacctgaaggaccagcagctgctgggcatctggggctgctccggcaagcacatctgcaccaccaacgtgccctggaactcctcctggtccaacaagtccctggaggagatctgggacaacatgacctggatggagtgggagcgcgagatcgacaactacaccggcctgatctactccctgatcgaggagtcccagaaccagcaggagaagaacgagcaggagctgctgcagctggacaagtgggcctccctgtggaactggttctccatcaccaactggctgtggtacatcaagatcttcatcatgatcgtgggcggcctgatcggcctgcgcatcgtgttcgccgtgctgtccctggtgaaccgcgtgcgccagggctactcccccctgtccttccagaccctgctgcccgccccccgcggccccgaccgccccgagggcatcgaggaggagggcggcgagcagggccgcggccgctccatccgcctggtgaacggcttctccgccctgatctgggacgacctgcgcaacctgtgcctgttctcctaccaccgcctgcgcgacctgatcctgatcgccacccgcatcgtggagctgctgggccgccgcggctgggaggccatcaagtacctgtggaacctgctgcagtactggatccaggagctgaagaactccgccatctccctgctggacaccaccgccatcgccgtggccgagggcaccgaccgcgccatcgagatcgtgcagcgcgccgtgcgcgccgtgctgaacatccccacccgcatccgccagggcctggagcgcgccctgctgtaa

SEQ ID NO: 108 - DNA, 2520 bp, Human immunodeficiency virus
atgcgcgtgaaggagacccagcgcaactggcacaacctgtggcgctggggcctgatgatcttcggcatgctgatgatctgcaacgccaccgagaacctgtgggtgaccgtgtactacggcgtgcccgtgtggaaggacgccgacaccaccctgttctgcgcctccgacgccaaggcctactccaccgagaagcacaacgtgtgggccacccacgcctgcgtgcccaccgaccccaacccccaggagatccccctggagaacgtgaccgagaacttcaacatgtggaagaacaacatggtggagcagatgcacgaggacatcatctccctgtgggacgagtccctgaagccctgcgtgaagctgacccccctgtgcgtgaccctgaactgcaccgacgtgaagaacgccaccaacaccaccgtggaggccgccgagatcaagaactgctccttcaacatcaccaccgagatcaaggacaagaagaagaaggagtacgccctgttctacaagctggacgtggtgcccatcaacgacaacaacaactccatctaccgcctgatcaactgcaacgtgtccaccgtgaagcaggcctgccccaaggtgaccttcgagcccatccccatccactactgcgcccccgccggcttcgccatcctgaagtgcaacgacaagaagttcaacggcaccggcccctgcaagaacgtgtccaccgtgcagtgcacccacggcatcaagcccgtggtgtccacccagctgctgctgaacggctccctggccgagggcgaggtgcgcatccgctccgagaacttcaccaacaacgccaagaccatcatcgtgcagctgaactcctccgtgcgcatcaactgcacccgccccaacaacaacacccgcaagtccatccacatcggccccggccaggccttctacgccaccggcgacatcatcggcgacatccgccaggcccactgcaacatctcccgcgccgagtggaacaacaccctgcagcaggtggccaagcagctgcgcgagaacttcaacaagaccatcatcttcaacaacccctccggcggcgacctggagatcaccacccactccttcaactgcggcggcgagttcttctactgcaacacctcccgcctgttcaactccacctggaacaacgacacccgcaacgacaccaagcagatgcacatcaccctgccctgccgcatcaagcagatcgtgaacatgtggcagcgcgtgggccaggccatgtacgccccccccatccagggcaagatccgctgcaactccaacatcaccggcctgctgctgacccgcgacggcggcaacaacaacaccaacgagaccttccgccccaccggcggcgacatgcgcgacaactggcgctccgagctgtacaagtacaaggtggtggagatcaagcccctgggcgtggcccccacccgcgccaagcgccgcgtggtggagcgcgagaagcgcgccgtgggcatcggcgccgtgctgctgggcttcctgggcgccgccggctccaccatgggcgccgcctccatcaccctgaccgtgcaggcccgccagctgctgtccggcatcgtgcagcagcagtccaacctgctgaaggccatcgaggcccagcagcacctgctgaagctgaccgtgtggggcatcaagcagctgcaggcccgcgtgctggccgtggagcgctacctgaaggaccagcagctgctgggcatctggggctgctccggcaagctgatctgcaccaccaacgtgccctggaacttctcctggtccaacaagtcctacgacgagatctgggacaacatgacctggatcgagtgggagcgcgagatcaacaactacacccagaccatctacaccctgctggaggagtcccagaaccagcaggagaagaacgagcaggacctgctggccctggacaagtgggcctccctgtggaactggttcgacatctccaactggctgtggtacatcaagatcttcatcatgatcgtgggcggcctgatcggcctgcgcatcatcttcgccgtgctgtccatcgtgaaccgctgccgccagggctactcccccctgtccttccagaccctgacccccaaccacaaggaggccgaccgccccggcggcatcgaggagggcggcggcgagcaggaccgcacccgctccatccgcctggtgtccggcttcctggccctggcctgggacgacctgcgcaacctgtgcctgttctcctaccaccgcctgcgcgacttcatcctgatcgccgcccgcatcgtggagaccctgggccgccgcggctgggagatcctgaagtacctgggcaacctggcccagtactggggccaggagctgaagaactccgccatctccctgctgaacgccaccgccatcgccgtggccgagggcaccgaccgcatcatcgaggtggtgcaccgcgtgctgcgcgccatcctgcacatcccccgccgcatccgccagggcttcgagcgcgccctgctgtaa

SEQ ID NO: 109 - protein, 838 aa, Human immunodeficiency virus
MRVRGMQRNWQHLGKWGLLFLGILIICNATENLWVTVYYGVPVWKEATTTLFCASDAKSYEREVHNVWATHACVPTDPNPQEVDLENVTENFDMWKNNMVEQMHTDIISLWDQSLKPCVKLTPLCVTLNCTDANATANATKEHPEGRAGAIQNCSFNMTTEVRDKQMKVQALFYRLDIVPISDNNSNEYRLINCNTSTITQACPKVSWDPIPIHYCAPAGYAILKCNDKKFNGTGPCKNVSTVQCTHGIKPVVSTQLLLNGSLAEEEIIIRSQNISDNAKTIIVHLNESVQINCTRPNNNTRKSIHIGPGRAFYATGDIIGDIRKAHCNVSGTQWNKTLEQVKKKLRSYFNTTIKFNSSSGGDPEITMHSFNCRGEFFYCNTSKLFNDTVSNDTIILPCRIKQIVNMWQEVGRAMYAAPIAGNITCTSNITGLLLTRDGGHNETNKTETFRPGGGNMKDNWRSELYKYKVVEIEPLGVAPTRAKRQVVKREKRAVGIGALFLGFLGAAGSTMGAASITLTVQARQLLSGIVQQQSNLLRAIEAQQHLLQLTVWGIKQLQARVLAVERYLKDQQLLGLWGCSGKLICTTNVPWNSSWSNKSQEEIWENMTWMEWEKEINNYSNEIYRLIEESQNQQEKNEQELLALDKWASLWNWFDISNWLWYIRIFIMIVGGLIGLRIVFAVLSIVNRVRKGYSPLSLQTHIPSPREPDRPEGIEEGGGEQGKDRSVRLVNGFLALIWDDLRSLCLFSYHRLRDLLLIVTRIVELLGRRGWEVLKYWWNLLQYWSQELKNSAISLLNTTAIVVAEGTDRVIEALQRVGRAILNIPRRIRQGLERALL

SEQ ID NO: 110 - protein, 855 aa, Human immunodeficiency virus
MKAKGTQRNWQSLWKWGTLILGLVIICSASNDLWVTVYYGVPVWKEATTTLFCASDAKAYDAEVHNVWATHACVPTDPNPQEVALENVTENFNMWENNMVDQMQEDIISLWDQSLKPCVELTPLCVTLNCTDFNNTTNNTTNTRNDGEGEIKNCSFNITTSLRDKIKKEYALFYNLDVVQMDNDNSSYRLTSCNTSIITQACPKVSFTPIPIHYCAPAGFVILKCNNKTFNGTGPCTNVSTVQCTHGIRPVVSTQLLLNGSLAEEEIVIRSKNFTDNAKTIIVQLKDPIEINCTRPNNNTRKRITMGPGRVLYTTGQIIGDIRKAHCNISKTKWNNTLGQIVKKLREQFMNKTIVFQRSSGGDPEIVMHSFNCGGEFFYCNTTQLFNSTWRSNSTWNDTTETNNTDLITLPCRIKQIVNMWQKVGKAMYAPPISGQIRCSSNITGLLLIRDGGSNNTETFRPGGGNMKDNWRSELYKYKVVKIEPLGVAPTRAKRRVVQREKRAVGIGALLFGFLGAAGSTMGAASMTLTVQARQLLSGIVQQQNNLLRAIEAQQHMLQLTVWGIKQLQARVLAVERYLKDQQLLGIWGCSGKLICTTTVPWNASWSNKSLDDIWNNMTWMEWEREIDNYTGLIYTLIEQSQNQQERNEQELLELDKWASLWNWFNITNWLWYIKIFIMIIGGLIGLRIVFAVLSIINRVRKGYSPLSFQTLTHHQREPDRPGRIEEEGGEQDKDRSIRLVSGFLALAWDDLRSLCLFSYHRLRDFILIAARTVELLGRSSLKGLRLGWEGLKYLWNLLLYWGRELKNSAINLLDTVAIAVANWTDRAIEVVQRVGRAVLNIPVRIRQGLERALL

SEQ ID NO: 111 - DNA, 2517 bp, Human immunodeficiency virus
atgcgcgtgcgcggcatgcagcgcaactggcagcacctgggcaagtggggcctgctgttcctgggcatcctgatcatctgcaacgccaccgagaacctgtgggtgaccgtgtactacggcgtgcccgtgtggaaggaggccaccaccaccctgttctgcgcctccgacgccaagtcctacgagcgcgaggtgcacaacgtgtgggccacccacgcctgcgtgcccaccgaccccaacccccaggaggtggacctggagaacgtgaccgagaacttcgacatgtggaagaacaacatggtggagcagatgcacaccgacatcatctccctgtgggaccagtccctgaagccctgcgtgaagctgacccccctgtgcgtgaccctgaactgcaccgacgccaacgccaccgccaacgccaccaaggagcaccccgagggccgcgccggcgccatccagaactgctccttcaacatgaccaccgaggtgcgcgacaagcagatgaaggtgcaggccctgttctaccgcctggacatcgtgcccatctccgacaacaactccaacgagtaccgcctgatcaactgcaacacctccaccatcacccaggcctgccccaaggtgtcctgggaccccatccccatccactactgcgcccccgccggctacgccatcctgaagtgcaacgacaagaagttcaacggcaccggcccctgcaagaacgtgtccaccgtgcagtgcacccacggcatcaagcccgtggtgtccacccagctgctgctgaacggctccctggccgaggaggagatcatcatccgctcccagaacatctccgacaacgccaagaccatcatcgtgcacctgaacgagtccgtgcagatcaactgcacccgccccaacaacaacacccgcaagtccatccacatcggccccggccgcgccttctacgccaccggcgacatcatcggcgacatccgcaaggcccactgcaacgtgtccggcacccagtggaacaagaccctggagcaggtgaagaagaagctgcgctcctacttcaacaccaccatcaagttcaactcctcctccggcggcgaccccgagatcaccatgcactccttcaactgccgcggcgagttcttctactgcaacacctccaagctgttcaacgacaccgtgtccaacgacaccatcatcctgccctgccgcatcaagcagatcgtgaacatgtggcaggaggtgggccgcgccatgtacgccgcccccatcgccggcaacatcacctgcacctccaacatcaccggcctgctgctgacccgcgacggcggccacaacgagaccaacaagaccgagaccttccgccccggcggcggcaacatgaaggacaactggcgctccgagctgtacaagtacaaggtggtggagatcgagcccctgggcgtggcccccacccgcgccaagcgccaggtggtgaagcgcgagaagcgcgccgtgggcatcggcgccctgttcctgggcttcctgggcgccgccggctccaccatgggcgccgcctccatcaccctgaccgtgcaggcccgccagctgctgtccggcatcgtgcagcagcagtccaacctgctgcgcgccatcgaggcccagcagcacctgctgcagctgaccgtgtggggcatcaagcagctgcaggcccgcgtgctggccgtggagcgctacctgaaggaccagcagctgctgggcctgtggggctgctccggcaagctgatctgcaccaccaacgtgccctggaactcctcctggtccaacaagtcccaggaggagatctgggagaacatgacctggatggagtgggagaaggagatcaacaactactccaacgagatctaccgcctgatcgaggagtcccagaaccagcaggagaagaacgagcaggagctgctggccctggacaagtgggcctccctgtggaactggttcgacatctccaactggctgtggtacatccgcatcttcatcatgatcgtgggcggcctgatcggcctgcgcatcgtgttcgccgtgctgtccatcgtgaaccgcgtgcgcaagggctactcccccctgtccctgcagacccacatcccctccccccgcgagcccgaccgccccgagggcatcgaggagggcggcggcgagcagggcaaggaccgctccgtgcgcctggtgaacggcttcctggccctgatctgggacgacctgcgctccctgtgcctgttctcctaccaccgcctgcgcgacctgctgctgatcgtgacccgcatcgtggagctgctgggccgccgcggctgggaggtgctgaagtactggtggaacctgctgcagtactggtcccaggagctgaagaactccgccatctccctgctgaacaccaccgccatcgtggtggccgagggcaccgaccgcgtgatcgaggccctgcagcgcgtgggccgcgccatcctgaacatcccccgccgcatccgccagggcctggagcgcgccctgctgtaa

SEQ ID NO: 112 - DNA, 2568 bp, Human immunodeficiency virus
atgaaggccaagggcacccagcgcaactggcagtccctgtggaagtggggcaccctgatcctgggcctggtgatcatctgctccgcctccaacgacctgtgggtgaccgtgtactacggcgtgcccgtgtggaaggaggccaccaccaccctgttctgcgcctccgacgccaaggcctacgacgccgaggtgcacaacgtgtgggccacccacgcctgcgtgcccaccgaccccaacccccaggaggtggccctggagaacgtgaccgagaacttcaacatgtgggagaacaacatggtggaccagatgcaggaggacatcatctccctgtgggaccagtccctgaagccctgcgtggagctgacccccctgtgcgtgaccctgaactgcaccgacttcaacaacaccaccaacaacaccaccaacacccgcaacgacggcgagggcgagatcaagaactgctccttcaacatcaccacctccctgcgcgacaagatcaagaaggagtacgccctgttctacaacctggacgtggtgcagatggacaacgacaactcctcctaccgcctgacctcctgcaacacctccatcatcacccaggcctgccccaaggtgtccttcacccccatccccatccactactgcgcccccgccggcttcgtgatcctgaagtgcaacaacaagaccttcaacggcaccggcccctgcaccaacgtgtccaccgtgcagtgcacccacggcatccgccccgtggtgtccacccagctgctgctgaacggctccctggccgaggaggagatcgtgatccgctccaagaacttcaccgacaacgccaagaccatcatcgtgcagctgaaggaccccatcgagatcaactgcacccgccccaacaacaacacccgcaagcgcatcaccatgggccccggccgcgtgctgtacaccaccggccagatcatcggcgacatccgcaaggcccactgcaacatctccaagaccaagtggaacaacaccctgggccagatcgtgaagaagctgcgcgagcagttcatgaacaagaccatcgtgttccagcgctcctccggcggcgaccccgagatcgtgatgcactccttcaactgcggcggcgagttcttctactgcaacaccacccagctgttcaactccacctggcgctccaactccacctggaacgacaccaccgagaccaacaacaccgacctgatcaccctgccctgccgcatcaagcagatcgtgaacatgtggcagaaggtgggcaaggccatgtacgccccccccatctccggccagatccgctgctcctccaacatcaccggcctgctgctgatccgcgacggcggctccaacaacaccgagaccttccgccccggcggcggcaacatgaaggacaactggcgctccgagctgtacaagtacaaggtggtgaagatcgagcccctgggcgtggcccccacccgcgccaagcgccgcgtggtgcagcgcgagaagcgcgccgtgggcatcggcgccctgctgttcggcttcctgggcgccgccggctccaccatgggcgccgcctccatgaccctgaccgtgcaggcccgccagctgctgtccggcatcgtgcagcagcagaacaacctgctgcgcgccatcgaggcccagcagcacatgctgcagctgaccgtgtggggcatcaagcagctgcaggcccgcgtgctggccgtggagcgctacctgaaggaccagcagctgctgggcatctggggctgctccggcaagctgatctgcaccaccaccgtgccctggaacgcctcctggtccaacaagtccctggacgacatctggaacaacatgacctggatggagtgggagcgcgagatcgacaactacaccggcctgatctacaccctgatcgagcagtcccagaaccagcaggagcgcaacgagcaggagctgctggagctggacaagtgggcctccctgtggaactggttcaacatcaccaactggctgtggtacatcaagatcttcatcatgatcatcggcggcctgatcggcctgcgcatcgtgttcgccgtgctgtccatcatcaaccgcgtgcgcaagggctactcccccctgtccttccagaccctgacccaccaccagcgcgagcccgaccgccccggccgcatcgaggaggagggcggcgagcaggacaaggaccgctccatccgcctggtgtccggcttcctggccctggcctgggacgacctgcgctccctgtgcctgttctcctaccaccgcctgcgcgacttcatcctgatcgccgcccgcaccgtggagctgctgggccgctcctccctgaagggcctgcgcctgggctgggagggcctgaagtacctgtggaacctgctgctgtactggggccgcgagctgaagaactccgccatcaacctgctggacaccgtggccatcgccgtggccaactggaccgaccgcgccatcgaggtggtgcagcgcgtgggccgcgccgtgctgaacatccccgtgcgcatccgccagggcctggagcgcgccctgctgtaa

SEQ ID NO: 113 - protein, 498 aa, Human immunodeficiency virus
MGARASVLSGGKLDAWEKIRLRPGGKKKYRLKHLVWASRELERFALNPGLLETSEGCQQIIEQLQPALQTGSEELRSLYNTVATLYCVHQRIEVKDTKEALDKIEEEQNKSKQKTQQAAADTGNSSKVSQNYPIVQNLQGQMVHQAISPRTLNAWVKVVEEKAFSPEVIPMFSALSEGATPQDLNTMLNTVGGHQAAMQMLKDTINEEAAEWDRLHPVHAGPIPPGQMREPRGSDIAGTTSTLQEQIGWMTSNPPIPVGEIYKRWIILGLNKIVRMYSPVSILDIRQGPKEPFRDYVDRFFKTLRAEQATQDVKNWMTDTLLVQNANPDCKTILKALGPGATLEEMMTACQGVGGPSHKARVLAEAMSQVTNTTIMMQRGNFKGQKRIIKCFNCGKEGHIARNCRAPRKKGCWKCGKEGHQMKDCTERQANFLGKIWPSNKGRPGNFLQSRPEPTAPPAESFGFGEEITPSPKQEPKDKELYPLASLKSLFGNDPLSQ

SEQ ID NO: 114 - DNA, 1497 bp, Human immunodeficiency virus
atgggcgcccgcgcctccgtgctgtccggcggcaagctggacgcctgggagaagatccgcctgcgccccggcggcaagaagaagtaccgcctgaagcacctggtgtgggcctcccgcgagctggagcgcttcgccctgaaccccggcctgctggagacctccgagggctgccagcagatcatcgagcagctgcagcccgccctgcagaccggctccgaggagctgcgctccctgtacaacaccgtggccaccctgtactgcgtgcaccagcgcatcgaggtgaaggacaccaaggaggccctggacaagatcgaggaggagcagaacaagtccaagcagaagacccagcaggccgccgccgacaccggcaactcctccaaggtgtcccagaactaccccatcgtgcagaacctgcagggccagatggtgcaccaggccatctccccccgcaccctgaacgcctgggtgaaggtggtggaggagaaggccttctcccccgaggtgatccccatgttctccgccctgtccgagggcgccaccccccaggacctgaacaccatgctgaacaccgtgggcggccaccaggccgccatgcagatgctgaaggacaccatcaacgaggaggccgccgagtgggaccgcctgcaccccgtgcacgccggccccatcccccccggccagatgcgcgagccccgcggctccgacatcgccggcaccacctccaccctgcaggagcagatcggctggatgacctccaacccccccatccccgtgggcgagatctacaagcgctggatcatcctgggcctgaacaagatcgtgcgcatgtactcccccgtgtccatcctggacatccgccagggccccaaggagcccttccgcgactacgtggaccgcttcttcaagaccctgcgcgccgagcaggccacccaggacgtgaagaactggatgaccgacaccctgctggtgcagaacgccaaccccgactgcaagaccatcctgaaggccctgggccccggcgccaccctggaggagatgatgaccgcctgccagggcgtgggcggcccctcccacaaggcccgcgtgctggccgaggccatgtcccaggtgaccaacaccaccatcatgatgcagcgcggcaacttcaagggccagaagcgcatcatcaagtgcttcaactgcggcaaggagggccacatcgcccgcaactgccgcgccccccgcaagaagggctgctggaagtgcggcaaggagggccaccagatgaaggactgcaccgagcgccaggccaacttcctgggcaagatctggccctccaacaagggccgccccggcaacttcctgcagtcccgccccgagcccaccgccccccccgccgagtccttcggcttcggcgaggagatcaccccctcccccaagcaggagcccaaggacaaggagctgtaccccctggcctccctgaagtccctgttcggcaacgaccccctgtcccagtaa

SEQ ID NO: 115 - protein, 498 aa, Human immunodeficiency virus
MGARASVLSGGKLDAWEKIRLRPGGKKKYRLKHLVWASRELERFALNPGLLETAEGCQQIMGQLQPALQTGTEELRSLYNTVATLYCVHQRIEVKDTKEALDKIEEEQNKSQQKTQQAAADKGDSSQVSQNYPIVQNLQGQMVHQAISPRTLNAWVKVVEEKAFSPEVIPMFSALSEGATPQDLNTMLNTVGGHQAAMQMLKDTINEEAAEWDRLHPVHAGPIPPGQMREPRGSDIAGTTSTLQEQIGWMTSNPPIPVGEIYKRWIILGLNKIVRMYSPVSILDIRQGPKEPFRDYVDRFFKTLRAEQATQDVKNWMTDTLLVQNANPDCKTILKALGPGATLEEMMTACQGVGGPGHKARVLAEAMSQVTNANIMMQRGNFKGPRRIVKCFNCGKEGHIARNCRAPRKKGCWKCGKEGHQMKDCTERQANFLGKIWPSNKGRPGNFLQSRPEPTAPPAESFGFGEEITPSPKQEPKDKELYPLASLKSLFGSDPLSQ

SEQ ID NO: 116 - DNA, 1497 bp, Human immunodeficiency virus
atgggcgcccgcgcctccgtgctgtccggcggcaagctggacgcctgggagaagatccgcctgcgccccggcggcaagaagaagtaccgcctgaagcacctggtgtgggcctcccgcgagctggagcgcttcgccctgaaccccggcctgctggagaccgccgagggctgccagcagatcatgggccagctgcagcccgccctgcagaccggcaccgaggagctgcgctccctgtacaacaccgtggccaccctgtactgcgtgcaccagcgcatcgaggtgaaggacaccaaggaggccctggacaagatcgaggaggagcagaacaagtcccagcagaagacccagcaggccgccgccgacaagggcgactcctcccaggtgtcccagaactaccccatcgtgcagaacctgcagggccagatggtgcaccaggccatctccccccgcaccctgaacgcctgggtgaaggtggtggaggagaaggccttctcccccgaggtgatccccatgttctccgccctgtccgagggcgccaccccccaggacctgaacaccatgctgaacaccgtgggcggccaccaggccgccatgcagatgctgaaggacaccatcaacgaggaggccgccgagtgggaccgcctgcaccccgtgcacgccggccccatcccccccggccagatgcgcgagccccgcggctccgacatcgccggcaccacctccaccctgcaggagcagatcggctggatgacctccaacccccccatccccgtgggcgagatctacaagcgctggatcatcctgggcctgaacaagatcgtgcgcatgtactcccccgtgtccatcctggacatccgccagggccccaaggagcccttccgcgactacgtggaccgcttcttcaagaccctgcgcgccgagcaggccacccaggacgtgaagaactggatgaccgacaccctgctggtgcagaacgccaaccccgactgcaagaccatcctgaaggccctgggccccggcgccaccctggaggagatgatgaccgcctgccagggcgtgggcggccccggccacaaggcccgcgtgctggccgaggccatgtcccaggtgaccaacgccaacatcatgatgcagcgcggcaacttcaagggcccccgccgcatcgtgaagtgcttcaactgcggcaaggagggccacatcgcccgcaactgccgcgccccccgcaagaagggctgctggaagtgcggcaaggagggccaccagatgaaggactgcaccgagcgccaggccaacttcctgggcaagatctggccctccaacaagggccgccccggcaacttcctgcagtcccgccccgagcccaccgccccccccgccgagtccttcggcttcggcgaggagatcaccccctcccccaagcaggagcccaaggacaaggagctgtaccccctggcctccctgaagtccctgttcggctccgaccccctgtcccagtaa

SEQ ID NO: 117 - protein, 498 aa, Human immunodeficiency virus
MGARASVLSGGKLDAWEKIRLRPGGKKKYRLKHLVWASRELERFALNPSLLETTEGCQQIMEQLQPALKTGTEELRSLYNTVATLYCVHQRIDVKDTKEALDKIEEIQNKSKQKTQQAAADTGNSSKVSQNYPIVQNAQGQMVHQSLSPRTLNAWVKVIEEKAFSPEVIPMFSALSEGATPQDLNMMLNIVGGHQAAMQMLKDTINEEAAEWDRLHPVHAGPIPPGQMREPRGSDIAGTTSTPQEQIGWMTGNPPIPVGDIYKRWIILGLNKIVRMYSPVSILDIKQGPKEPFRDYVDRFFKTLRAEQATQEVKNWMTETLLVQNANPDCKSILRALGPGATLEEMMTACQGVGGPGHKARVLAEAMSQVQHTNIMMQRGNFRGQKRIKCFNCGKEGHLARNCRAPRKKGCWKCGKEGHQMKDCTERQANFLGKIWPSSKGRPGNFPQSRPEPTAPPAEIFGMGEEITSPPKQEQKDREQDPPLVSLKSLFGNDPLSQ

SEQ ID NO: 118 - DNA, 1497 bp, Human immunodeficiency virus
atgggcgcccgcgcctccgtgctgtccggcggcaagctggacgcctgggagaagatccgcctgcgccccggcggcaagaagaagtaccgcctgaagcacctggtgtgggcctcccgcgagctggagcgcttcgccctgaacccctccctgctggagaccaccgagggctgccagcagatcatggagcagctgcagcccgccctgaagaccggcaccgaggagctgcgctccctgtacaacaccgtggccaccctgtactgcgtgcaccagcgcatcgacgtgaaggacaccaaggaggccctggacaagatcgaggagatccagaacaagtccaagcagaagacccagcaggccgccgccgacaccggcaactcctccaaggtgtcccagaactaccccatcgtgcagaacgcccagggccagatggtgcaccagtccctgtccccccgcaccctgaacgcctgggtgaaggtgatcgaggagaaggccttctcccccgaggtgatccccatgttctccgccctgtccgagggcgccaccccccaggacctgaacatgatgctgaacatcgtgggcggccaccaggccgccatgcagatgctgaaggacaccatcaacgaggaggccgccgagtgggaccgcctgcaccccgtgcacgccggccccatcccccccggccagatgcgcgagccccgcggctccgacatcgccggcaccacctccaccccccaggagcagatcggctggatgaccggcaacccccccatccccgtgggcgacatctacaagcgctggatcatcctgggcctgaacaagatcgtgcgcatgtactcccccgtgtccatcctggacatcaagcagggccccaaggagcccttccgcgactacgtggaccgcttcttcaagaccctgcgcgccgagcaggccacccaggaggtgaagaactggatgaccgagaccctgctggtgcagaacgccaaccccgactgcaagtccatcctgcgcgccctgggccccggcgccaccctggaggagatgatgaccgcctgccagggcgtgggcggccccggccacaaggcccgcgtgctggccgaggccatgtcccaggtgcagcacaccaacatcatgatgcagcgcggcaacttccgcggccagaagcgcatcaagtgcttcaactgcggcaaggagggccacctggcccgcaactgccgcgccccccgcaagaagggctgctggaagtgcggcaaggagggccaccagatgaaggactgcaccgagcgccaggccaacttcctgggcaagatctggccctcctccaagggccgccccggcaacttcccccagtcccgccccgagcccaccgccccccccgccgagatcttcggcatgggcgaggagatcacctccccccccaagcaggagcagaaggaccgcgagcaggacccccccctggtgtccctgaagtccctgttcggcaacgaccccctgtcccagtaa

SEQ ID NO: 119 - protein, 498 aa, Human immunodeficiency virus
MGARASVLSGGKLDAWEKIRLRPGGKKKYRLKHLVWASRELERFALNPGLLETAEGCQQIMGQLQPALKTGTEELRSLYNTVATLYCVHQRIEVKDTKEALDKIEEIQNKSKQKTQQAAADTGNSSKVSQNYPIVQNAQGQMVHQSLSPRTLNAWVKVIEEKAFSPEVIPMFSALSEGATPQDLNMMLNIVGGHQAAMQMLKDTINEEAAEWDRLHPVHAGPIPPGQMREPRGSDIAGTTSTLQEQIGWMTGNPPIPVGDIYKRWIILGLNKIVRMYSPVSILDIRQGPKEPFRDYVDRFFKTLRAEQATQEVKNWMTETLLVQNANPDCKSILRALGPGATLEEMMTACQGVGGPGHKARVLAEAMSQVQNTDIMMQRGNFRGPKRIKCFNCGKEGHLARNCRAPRKKGCWKCGKEGHQMKDCTERQANFLGKIWPSSKGRPGNFPQSRPEPTAPPAENFGMGEEMISSPKQEQKDREQYPPLVSLKSLFGNDPLSQ

SEQ ID NO: 120 - DNA, 1497 bp, Human immunodeficiency virus
atgggcgcccgcgcctccgtgctgtccggcggcaagctggacgcctgggagaagatccgcctgcgccccggcggcaagaagaagtaccgcctgaagcacctggtgtgggcctcccgcgagctggagcgcttcgccctgaaccccggcctgctggagaccgccgagggctgccagcagatcatgggccagctgcagcccgccctgaagaccggcaccgaggagctgcgctccctgtacaacaccgtggccaccctgtactgcgtgcaccagcgcatcgaggtgaaggacaccaaggaggccctggacaagatcgaggagatccagaacaagtccaagcagaagacccagcaggccgccgccgacaccggcaactcctccaaggtgtcccagaactaccccatcgtgcagaacgcccagggccagatggtgcaccagtccctgtccccccgcaccctgaacgcctgggtgaaggtgatcgaggagaaggccttctcccccgaggtgatccccatgttctccgccctgtccgagggcgccaccccccaggacctgaacatgatgctgaacatcgtgggcggccaccaggccgccatgcagatgctgaaggacaccatcaacgaggaggccgccgagtgggaccgcctgcaccccgtgcacgccggccccatcccccccggccagatgcgcgagccccgcggctccgacatcgccggcaccacctccaccctgcaggagcagatcggctggatgaccggcaacccccccatccccgtgggcgacatctacaagcgctggatcatcctgggcctgaacaagatcgtgcgcatgtactcccccgtgtccatcctggacatccgccagggccccaaggagcccttccgcgactacgtggaccgcttcttcaagaccctgcgcgccgagcaggccacccaggaggtgaagaactggatgaccgagaccctgctggtgcagaacgccaaccccgactgcaagtccatcctgcgcgccctgggccccggcgccaccctggaggagatgatgaccgcctgccagggcgtgggcggccccggccacaaggcccgcgtgctggccgaggccatgtcccaggtgcagaacaccgacatcatgatgcagcgcggcaacttccgcggccccaagcgcatcaagtgcttcaactgcggcaaggagggccacctggcccgcaactgccgcgccccccgcaagaagggctgctggaagtgcggcaaggagggccaccagatgaaggactgcaccgagcgccaggccaacttcctgggcaagatctggccctcctccaagggccgccccggcaacttcccccagtcccgccccgagcccaccgccccccccgccgagaacttcggcatgggcgaggagatgatctcctcccccaagcaggagcagaaggaccgcgagcagtacccccccctggtgtccctgaagtccctgttcggcaacgaccccctgtcccagtaa

SEQ ID NO: 121 - protein, 500 aa, Human immunodeficiency virus
MGARASILSGGKLDAWEKIRLRPGGKKKYRLKHLVWASRELEKFSINPSLLETSEGCRQIIRQLQPALQTGTEELKSLYNTVAVLYCVHQRIDVKDTKEALDKIEEEQNKCKQKTQHAAADTGNSSSSSQNYPIVQNAQGQMVHQAISPRTLNAWVKVVEEKAFSPEVIPMFTALSEGATPQDLNTMLNTVGGHQAAMQMLKDTINEEAAEWDRLHPVHAGPIPPGQMREPRGSDIAGTTSTLQEQIGWMTSNPPIPVGEIYKRWIILGLNKIVRMYSPVSILDIRQGPKEPFRDYVDRFFKTLRAEQATQEVKNWMTDTLLVQNANPDCKSILRALGPGATLEEMMTACQGVGGPSHKARVLAEAMSQVQNTNTNIMMQRGNFRGQKRIKCFNCGKEGHLARNCRAPRKKGCWKCGKEGHQMKDCTERQANFLGKIWPSNKGRPGNFPQSRTEPTAPPAENLRMGEEITSSLKQELKTREPYNPAISLKSLFGNDPLSQ

SEQ ID NO: 122 - DNA, 1503 bp, Human immunodeficiency virus
atgggcgcccgcgcctccatcctgtccggcggcaagctggacgcctgggagaagatccgcctgcgccccggcggcaagaagaagtaccgcctgaagcacctggtgtgggcctcccgcgagctggagaagttctccatcaacccctccctgctggagacctccgagggctgccgccagatcatccgccagctgcagcccgccctgcagaccggcaccgaggagctgaagtccctgtacaacaccgtggccgtgctgtactgcgtgcaccagcgcatcgacgtgaaggacaccaaggaggccctggacaagatcgaggaggagcagaacaagtgcaagcagaagacccagcacgccgccgccgacaccggcaactcctcctcctcctcccagaactaccccatcgtgcagaacgcccagggccagatggtgcaccaggccatctccccccgcaccctgaacgcctgggtgaaggtggtggaggagaaggccttctcccccgaggtgatccccatgttcaccgccctgtccgagggcgccaccccccaggacctgaacaccatgctgaacaccgtgggcggccaccaggccgccatgcagatgctgaaggacaccatcaacgaggaggccgccgagtgggaccgcctgcaccccgtgcacgccggccccatcccccccggccagatgcgcgagccccgcggctccgacatcgccggcaccacctccaccctgcaggagcagatcggctggatgacctccaacccccccatccccgtgggcgagatctacaagcgctggatcatcctgggcctgaacaagatcgtgcgcatgtactcccccgtgtccatcctggacatccgccagggccccaaggagcccttccgcgactacgtggaccgcttcttcaagaccctgcgcgccgagcaggccacccaggaggtgaagaactggatgaccgacaccctgctggtgcagaacgccaaccccgactgcaagtccatcctgcgcgccctgggccccggcgccaccctggaggagatgatgaccgcctgccagggcgtgggcggcccctcccacaaggcccgcgtgctggccgaggccatgtcccaggtgcagaacaccaacaccaacatcatgatgcagcgcggcaacttccgcggccagaagcgcatcaagtgcttcaactgcggcaaggagggccacctggcccgcaactgccgcgccccccgcaagaagggctgctggaagtgcggcaaggagggccaccagatgaaggactgcaccgagcgccaggccaacttcctgggcaagatctggccctccaacaagggccgccccggcaacttcccccagtcccgcaccgagcccaccgccccccccgccgagaacctgcgcatgggcgaggagatcacctcctccctgaagcaggagctgaagacccgcgagccctacaaccccgccatctccctgaagtccctgttcggcaacgaccccctgtcccagtaa

SEQ ID NO: 123 - protein, 488 aa, Human immunodeficiency virus
MGARASVLSGGELDRWEKIRLRPGGKKKYKLKHIVWASRELERFAVNPGLLETSEGCRQILGQLQPSLQTGSEELRSLYNTVATLYCVHQRIEVKDTKEALEKIEEEQNKSKKKAQQAAADTGNSSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSATIMMQRGNFRNQRKTVKCFNCGKEGHIAKNCRAPRKKGCWKCGKEGHQMKDCTERQANFLGKIWPSHKGRPGNFLQSRPEPTAPPEESFRFGEETTTPSQKQEPIDKELYPLAS

SEQ ID NO: 124 - DNA, 1467 bp, Human immunodeficiency virus
atgggcgcccgcgcctccgtgctgtccggcggcgagctggaccgctgggagaagatccgcctgcgccccggcggcaagaagaagtacaagctgaagcacatcgtgtgggcctcccgcgagctggagcgcttcgccgtgaaccccggcctgctggagacctccgagggctgccgccagatcctgggccagctgcagccctccctgcagaccggctccgaggagctgcgctccctgtacaacaccgtggccaccctgtactgcgtgcaccagcgcatcgaggtgaaggacaccaaggaggccctggagaagatcgaggaggagcagaacaagtccaagaagaaggcccagcaggccgccgccgacaccggcaactcctcccaggtgtcccagaactaccccatcgtgcagaacctgcagggccagatggtgcaccaggccatctccccccgcaccctgaacgcctgggtgaaggtggtggaggagaaggccttctcccccgaggtgatccccatgttctccgccctgtccgagggcgccaccccccaggacctgaacaccatgctgaacaccgtgggcggccaccaggccgccatgcagatgctgaaggagaccatcaacgaggaggccgccgagtgggaccgcctgcaccccgtgcacgccggccccatcgcccccggccagatgcgcgagccccgcggctccgacatcgccggcaccacctccaccctgcaggagcagatcggctggatgaccaacaacccccccatccccgtgggcgagatctacaagcgctggatcatcctgggcctgaacaagatcgtgcgcatgtactcccccacctccatcctggacatccgccagggccccaaggagcccttccgcgactacgtggaccgcttctacaagaccctgcgcgccgagcaggcctcccaggaggtgaagaactggatgaccgagaccctgctggtgcagaacgccaaccccgactgcaagaccatcctgaaggccctgggccccgccgccaccctggaggagatgatgaccgcctgccagggcgtgggcggccccggccacaaggcccgcgtgctggccgaggccatgtcccaggtgaccaactccgccaccatcatgatgcagcgcggcaacttccgcaaccagcgcaagaccgtgaagtgcttcaactgcggcaaggagggccacatcgccaagaactgccgcgccccccgcaagaagggctgctggaagtgcggcaaggagggccaccagatgaaggactgcaccgagcgccaggccaacttcctgggcaagatctggccctcccacaagggccgccccggcaacttcctgcagtcccgccccgagcccaccgccccccccgaggagtccttccgcttcggcgaggagaccaccaccccctcccagaagcaggagcccatcgacaaggagctgtaccccctggcctcctaa

SEQ ID NO: 125 - protein, 500 aa, Human immunodeficiency virus
MGARASVLSGGKLDKWEKIRLRPGGKKKYKLKHIVWASRELERFAVNPGLLETSEGCRQILGQLQPALQTGSEELRSLYNTVATLYCVHQRIEVKDTKEALDKIEEEQNKSKKKAQQAAADTGNSSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPISILDIRQGPKEPFRDYVDRFYKTLRAEQASQDVKNWMTETLLVQNANPDCKTILKALGPAATLEEMMTACQGVGGPGHKARVLAEAMSQVTNSTTIMMQRGNFRDQRKIVKCFNCGKEGHIARNCRAPRKKGCWKCGKEGHQMKDCTERQANFLGKIWPSHKGRPGNFLQSRPEPTAPPEESFRFGEETTTPSQKQEPIDKELYPLASLKSLFGNDPSSQ

SEQ ID NO: 126 - DNA, 1503 bp, Human immunodeficiency virus
atgggcgcccgcgcctccgtgctgtccggcggcaagctggacaagtgggagaagatccgcctgcgccccggcggcaagaagaagtacaagctgaagcacatcgtgtgggcctcccgcgagctggagcgcttcgccgtgaaccccggcctgctggagacctccgagggctgccgccagatcctgggccagctgcagcccgccctgcagaccggctccgaggagctgcgctccctgtacaacaccgtggccaccctgtactgcgtgcaccagcgcatcgaggtgaaggacaccaaggaggccctggacaagatcgaggaggagcagaacaagtccaagaagaaggcccagcaggccgccgccgacaccggcaactcctcccaggtgtcccagaactaccccatcgtgcagaacctgcagggccagatggtgcaccaggccatctccccccgcaccctgaacgcctgggtgaaggtggtggaggagaaggccttctcccccgaggtgatccccatgttctccgccctgtccgagggcgccaccccccaggacctgaacaccatgctgaacaccgtgggcggccaccaggccgccatgcagatgctgaaggagaccatcaacgaggaggccgccgagtgggaccgcctgcaccccgtgcacgccggccccatcgcccccggccagatgcgcgagccccgcggctccgacatcgccggcaccacctccaccctgcaggagcagatcggctggatgaccaacaacccccccatccccgtgggcgagatctacaagcgctggatcatcctgggcctgaacaagatcgtgcgcatgtactcccccatctccatcctggacatccgccagggccccaaggagcccttccgcgactacgtggaccgcttctacaagaccctgcgcgccgagcaggcctcccaggacgtgaagaactggatgaccgagaccctgctggtgcagaacgccaaccccgactgcaagaccatcctgaaggccctgggccccgccgccaccctggaggagatgatgaccgcctgccagggcgtgggcggccccggccacaaggcccgcgtgctggccgaggccatgtcccaggtgaccaactccaccaccatcatgatgcagcgcggcaacttccgcgaccagcgcaagatcgtgaagtgcttcaactgcggcaaggagggccacatcgcccgcaactgccgcgccccccgcaagaagggctgctggaagtgcggcaaggagggccaccagatgaaggactgcaccgagcgccaggccaacttcctgggcaagatctggccctcccacaagggccgccccggcaacttcctgcagtcccgccccgagcccaccgccccccccgaggagtccttccgcttcggcgaggagaccaccaccccctcccagaagcaggagcccatcgacaaggagctgtaccccctggcctccctgaagtccctgttcggcaacgacccctcctcccagtaa

SEQ ID NO: 127 - protein, 492 aa, Human immunodeficiency virus
MGARASILRGGKLDKWEKIRLRPGGKKHYMLKHLVWASRELERFALNPGLLETSEGCKQIIKQLQPALQTGTEELRSLYNTVATLYCVHEKIEVRDTKEALDKIEEEQNKSQQKTQQAKAADGKVSQNYPIVQNLQGQMVHQAISPRTLNAWVKVIEEKAFSPEVIPMFTALSEGATPQDLNTMLNTVGGHQAAMQMLKDTINEEAAEWDRLHPVHAGPIAPGQMREPRGSDIAGTTSTLQEQIAWMTSNPPIPVGDIYKRWIILGLNKIVRMYSPVSILDIKQGPKEPFRDYVDRFFKTLRAEQATQDVKNWMTDTLLVQNANPDCKTILRALGPGATLEEMMTACQGVGGPSHKARVLAEAMSQANNTNIMMQRSNFKGPKRIVKCFNCGKEGHIARNCRAPRKKGCWKCGKEGHQMKDCTERQANFLGKIWPSHKGRPGNFLQNRPEPTAPPAESFRFEETTPAPKQEPKDREPLTSLKSLFGSDPLSQ

SEQ ID NO: 128 - DNA, 1479 bp, Human immunodeficiency virus
atgggcgcccgcgcctccatcctgcgcggcggcaagctggacaagtgggagaagatccgcctgcgccccggcggcaagaagcactacatgctgaagcacctggtgtgggcctcccgcgagctggagcgcttcgccctgaaccccggcctgctggagacctccgagggctgcaagcagatcatcaagcagctgcagcccgccctgcagaccggcaccgaggagctgcgctccctgtacaacaccgtggccaccctgtactgcgtgcacgagaagatcgaggtgcgcgacaccaaggaggccctggacaagatcgaggaggagcagaacaagtcccagcagaagacccagcaggccaaggccgccgacggcaaggtgtcccagaactaccccatcgtgcagaacctgcagggccagatggtgcaccaggccatctccccccgcaccctgaacgcctgggtgaaggtgatcgaggagaaggccttctcccccgaggtgatccccatgttcaccgccctgtccgagggcgccaccccccaggacctgaacaccatgctgaacaccgtgggcggccaccaggccgccatgcagatgctgaaggacaccatcaacgaggaggccgccgagtgggaccgcctgcaccccgtgcacgccggccccatcgcccccggccagatgcgcgagccccgcggctccgacatcgccggcaccacctccaccctgcaggagcagatcgcctggatgacctccaacccccccatccccgtgggcgacatctacaagcgctggatcatcctgggcctgaacaagatcgtgcgcatgtactcccccgtgtccatcctggacatcaagcagggccccaaggagcccttccgcgactacgtggaccgcttcttcaagaccctgcgcgccgagcaggccacccaggacgtgaagaactggatgaccgacaccctgctggtgcagaacgccaaccccgactgcaagaccatcctgcgcgccctgggccccggcgccaccctggaggagatgatgaccgcctgccagggcgtgggcggcccctcccacaaggcccgcgtgctggccgaggccatgtcccaggccaacaacaccaacatcatgatgcagcgctccaacttcaagggccccaagcgcatcgtgaagtgcttcaactgcggcaaggagggccacatcgcccgcaactgccgcgccccccgcaagaagggctgctggaagtgcggcaaggagggccaccagatgaaggactgcaccgagcgccaggccaacttcctgggcaagatctggccctcccacaagggccgccccggcaacttcctgcagaaccgccccgagcccaccgccccccccgccgagtccttccgcttcgaggagaccacccccgcccccaagcaggagcccaaggaccgcgagcccctgacctccctgaagtccctgttcggctccgaccccctgtcccagtaa

SEQ ID NO: 129 - protein, 495 aa, Human immunodeficiency virus
MGARASILRGGKLDTWEKIRLRPGGKKHYMIKHLVWASRELERFALNPGLLETSEGCKQIMKQLQPALQTGTEELRSLYNTVATLYCVHERIEVRDTKEALDKIEEEQNKSQQKTQQAEAADGDNGKVSQNYPIVQNLQGQMVHQAISPRTLNAWVKVVEEKAFSPEVIPMFTALSEGATPQDLNTMLNTVGGHQAAMQMLKDTINEEAAEWDRLHPVHAGPVAPGQMREPRGSDIAGTTSTLQEQIAWMTSNPPIPVGDIYKRWIILGLNKIVRMYSPVSILDIKQGPKEPFRDYVDRFFKTLRAEQATQDVKNWMTDTLLVQNANPDCKTILRALGPGATLEEMMTACQGVGGPGHKARVLAEAMSQANNTNIMMQRSNFKGPKRIVKCFNCGKEGHIARNCRAPRKKGCWKCGKEGHQMKDCTERQANFLGKIWPSHKGRPGNFLQSRPEPTAPPAESFRFEETTPAPKQEPKDREPLTSLKSLFGSDPLSQ

SEQ ID NO: 130 - DNA, 1488 bp, Human immunodeficiency virus
atgggcgcccgcgcctccatcctgcgcggcggcaagctggacacctgggagaagatccgcctgcgccccggcggcaagaagcactacatgatcaagcacctggtgtgggcctcccgcgagctggagcgcttcgccctgaaccccggcctgctggagacctccgagggctgcaagcagatcatgaagcagctgcagcccgccctgcagaccggcaccgaggagctgcgctccctgtacaacaccgtggccaccctgtactgcgtgcacgagcgcatcgaggtgcgcgacaccaaggaggccctggacaagatcgaggaggagcagaacaagtcccagcagaagacccagcaggccgaggccgccgacggcgacaacggcaaggtgtcccagaactaccccatcgtgcagaacctgcagggccagatggtgcaccaggccatctccccccgcaccctgaacgcctgggtgaaggtggtggaggagaaggccttctcccccgaggtgatccccatgttcaccgccctgtccgagggcgccaccccccaggacctgaacaccatgctgaacaccgtgggcggccaccaggccgccatgcagatgctgaaggacaccatcaacgaggaggccgccgagtgggaccgcctgcaccccgtgcacgccggccccgtggcccccggccagatgcgcgagccccgcggctccgacatcgccggcaccacctccaccctgcaggagcagatcgcctggatgacctccaacccccccatccccgtgggcgacatctacaagcgctggatcatcctgggcctgaacaagatcgtgcgcatgtactcccccgtgtccatcctggacatcaagcagggccccaaggagcccttccgcgactacgtggaccgcttcttcaagaccctgcgcgccgagcaggccacccaggacgtgaagaactggatgaccgacaccctgctggtgcagaacgccaaccccgactgcaagaccatcctgcgcgccctgggccccggcgccaccctggaggagatgatgaccgcctgccagggcgtgggcggccccggccacaaggcccgcgtgctggccgaggccatgtcccaggccaacaacaccaacatcatgatgcagcgctccaacttcaagggccccaagcgcatcgtgaagtgcttcaactgcggcaaggagggccacatcgcccgcaactgccgcgccccccgcaagaagggctgctggaagtgcggcaaggagggccaccagatgaaggactgcaccgagcgccaggccaacttcctgggcaagatctggccctcccacaagggccgccccggcaacttcctgcagtcccgccccgagcccaccgccccccccgccgagtccttccgcttcgaggagaccacccccgcccccaagcaggagcccaaggaccgcgagcccctgacctccctgaagtccctgttcggctccgaccccctgtcccagtaa

SEQ ID NO: 131 - protein, 499 aa, Human immunodeficiency virus
MGARASVLSGGKLDAWEKIRLRPGGKKKYRLKHIVWASRELERFALNPGLLETSEGCKQIIGQLQPAIQTGSEELRSLYNTVATLYCVHERIEVKDTKEALEKIEEEQNKSKKKAQQAAADTGNSSQVSQNYPIVQNLQGQMVHQAISPRTLNAWVKVIEEKAFSPEVIPMFSALSEGATPQDLNTMLNTVGGHQAAMQMLKETINEEAAEWDRLHPVHAGPVAPGQMREPRGSDIAGTTSTLQEQIGWMTSNPPIPVGEIYKRWIILGLNKIVRMYSPVSILDIRQGPKEPFRDYVDRFYKTLRAEQASQDVKNWMTETLLVQNANPDCKTILKALGPEATLEEMMTACQGVGGPSHKARVLAEAMSQATNSAAVMMQRGNFKGPRKIIKCFNCGKEGHIAKNCRAPRKKGCWKCGKEGHQMKDCTERQANFLGKIWPSHKGRPGNFLQSRPEPTAPPAESFGFGEEITPSQKQEQKDKELYPLTSLKSLFGNDPLSQ

SEQ ID NO: 132 - DNA, 1500 bp, Human immunodeficiency virus
atgggcgcccgcgcctccgtgctgtccggcggcaagctggacgcctgggagaagatccgcctgcgccccggcggcaagaagaagtaccgcctgaagcacatcgtgtgggcctcccgcgagctggagcgcttcgccctgaaccccggcctgctggagacctccgagggctgcaagcagatcatcggccagctgcagcccgccatccagaccggctccgaggagctgcgctccctgtacaacaccgtggccaccctgtactgcgtgcacgagcgcatcgaggtgaaggacaccaaggaggccctggagaagatcgaggaggagcagaacaagtccaagaagaaggcccagcaggccgccgccgacaccggcaactcctcccaggtgtcccagaactaccccatcgtgcagaacctgcagggccagatggtgcaccaggccatctccccccgcaccctgaacgcctgggtgaaggtgatcgaggagaaggccttctcccccgaggtgatccccatgttctccgccctgtccgagggcgccaccccccaggacctgaacaccatgctgaacaccgtgggcggccaccaggccgccatgcagatgctgaaggagaccatcaacgaggaggccgccgagtgggaccgcctgcaccccgtgcacgccggccccgtggcccccggccagatgcgcgagccccgcggctccgacatcgccggcaccacctccaccctgcaggagcagatcggctggatgacctccaacccccccatccccgtgggcgagatctacaagcgctggatcatcctgggcctgaacaagatcgtgcgcatgtactcccccgtgtccatcctggacatccgccagggccccaaggagcccttccgcgactacgtggaccgcttctacaagaccctgcgcgccgagcaggcctcccaggacgtgaagaactggatgaccgagaccctgctggtgcagaacgccaaccccgactgcaagaccatcctgaaggccctgggccccgaggccaccctggaggagatgatgaccgcctgccagggcgtgggcggcccctcccacaaggcccgcgtgctggccgaggccatgtcccaggccaccaactccgccgccgtgatgatgcagcgcggcaacttcaagggcccccgcaagatcatcaagtgcttcaactgcggcaaggagggccacatcgccaagaactgccgcgccccccgcaagaagggctgctggaagtgcggcaaggagggccaccagatgaaggactgcaccgagcgccaggccaacttcctgggcaagatctggccctcccacaagggccgccccggcaacttcctgcagtcccgccccgagcccaccgccccccccgccgagtccttcggcttcggcgaggagatcaccccctcccagaagcaggagcagaaggacaaggagctgtaccccctgacctccctgaagtccctgttcggcaacgaccccctgtcccagtaa

SEQ ID NO: 133 - protein, 492 aa, Human immunodeficiency virus
MGARASVLSGGKLDAWEKIRLRPGGKKKYRMKHLVWASRELERFALDPGLLETSEGCQKIIGQLQPSLQTGSEELRSLYNTVAVLYCVHQKVEVKDTKEALEKLEEEQNKSQQKTQQAAADKGVSQNYPIVQNLQGQMVHQAISPRTLNAWVKVIEEKAFSPEVIPMFSALSEGATPQDLNTMLNTVGGHQAAMQMLKDTINEEAAEWDRLHPVHAGPIPPGQMREPRGSDIAGTTSTLQEQIQWMTSNPPVPVGDIYKRWIILGLNKIVRMYSPVSILDIRQGPKEPFRDYVDRFFKTLRAEQATQEVKGWMTDTLLVQNANPDCKTILKALGPGATLEEMMTACQGVGGPGHKARVLAEAMSQATNTAIMMQKSNFKGQRRIVKCFNCGKEGHIAKNCRAPRKKGCWKCGREGHQMKDCTERQANFLGKIWPSNKGRPGNFLQSRPEPTAPPAESFGFREEITPSPKQEQKDEGLYPPLASLKSLFGNDP

SEQ ID NO: 134 - DNA, 1479 bp, Human immunodeficiency virus
atgggcgcccgcgcctccgtgctgtccggcggcaagctggacgcctgggagaagatccgcctgcgccccggcggcaagaagaagtaccgcatgaagcacctggtgtgggcctcccgcgagctggagcgcttcgccctggaccccggcctgctggagacctccgagggctgccagaagatcatcggccagctgcagccctccctgcagaccggctccgaggagctgcgctccctgtacaacaccgtggccgtgctgtactgcgtgcaccagaaggtggaggtgaaggacaccaaggaggccctggagaagctggaggaggagcagaacaagtcccagcagaagacccagcaggccgccgccgacaagggcgtgtcccagaactaccccatcgtgcagaacctgcagggccagatggtgcaccaggccatctccccccgcaccctgaacgcctgggtgaaggtgatcgaggagaaggccttctcccccgaggtgatccccatgttctccgccctgtccgagggcgccaccccccaggacctgaacaccatgctgaacaccgtgggcggccaccaggccgccatgcagatgctgaaggacaccatcaacgaggaggccgccgagtgggaccgcctgcaccccgtgcacgccggccccatcccccccggccagatgcgcgagccccgcggctccgacatcgccggcaccacctccaccctgcaggagcagatccagtggatgacctccaacccccccgtgcccgtgggcgacatctacaagcgctggatcatcctgggcctgaacaagatcgtgcgcatgtactcccccgtgtccatcctggacatccgccagggccccaaggagcccttccgcgactacgtggaccgcttcttcaagaccctgcgcgccgagcaggccacccaggaggtgaagggctggatgaccgacaccctgctggtgcagaacgccaaccccgactgcaagaccatcctgaaggccctgggccccggcgccaccctggaggagatgatgaccgcctgccagggcgtgggcggccccggccacaaggcccgcgtgctggccgaggccatgtcccaggccaccaacaccgccatcatgatgcagaagtccaacttcaagggccagcgccgcatcgtgaagtgcttcaactgcggcaaggagggccacatcgccaagaactgccgcgccccccgcaagaagggctgctggaagtgcggccgcgagggccaccagatgaaggactgcaccgagcgccaggccaacttcctgggcaagatctggccctccaacaagggccgccccggcaacttcctgcagtcccgccccgagcccaccgccccccccgccgagtccttcggcttccgcgaggagatcaccccctcccccaagcaggagcagaaggacgagggcctgtacccccccctggcctccctgaagtccctgttcggcaacgacccctaa

SEQ ID NO: 135 - protein, 497 aa, Human immunodeficiency virus
MGARASVLSGGKLDAWEKIRLRPGGKKKYRMKHLVWASRELERFALNPDLLETAEGCQQIMGQLQPALQTGTEELRSLFNTVATLYCVHQRIEVKDTKEALEEVEKIQKKSQQKTQQAAMDEGNSSQVSQNYPIVQNAQGQMVHQAISPRTLNAWVKVVEEKAFSPEVIPMFSALSEGATPQDLNTMLNTVGGHQAAMQMLKDTINEEAAEWDRMHPQQAGPIPPGQIREPRGSDIAGTTSTLQEQIRWMTSNPPIPVGEIYKRWIILGLNKIVRMYSPVSILDIRQGPKEPFRDYVDRFFKTLRAEQATQEVKGWMTDTLLVQNANPDCKTILRALGPGATLEEMMTACQGVGGPSHKARVLAEAMSQASGAAAAIMMQKSNFKGPRRTIKCFNCGKEGHLARNCRAPRKKGCWKCGKEGHQMKDCTERQANFLGKIWPSNKGRPGNFLQNRPEPTAPPAESFGFGEEIAPSPKQEQKEKELYPLASLKSLFGSDP

SEQ ID NO: 136 - DNA, 1494 bp, Human immunodeficiency virus
atgggcgcccgcgcctccgtgctgtccggcggcaagctggacgcctgggagaagatccgcctgcgccccggcggcaagaagaagtaccgcatgaagcacctggtgtgggcctcccgcgagctggagcgcttcgccctgaaccccgacctgctggagaccgccgagggctgccagcagatcatgggccagctgcagcccgccctgcagaccggcaccgaggagctgcgctccctgttcaacaccgtggccaccctgtactgcgtgcaccagcgcatcgaggtgaaggacaccaaggaggccctggaggaggtggagaagatccagaagaagtcccagcagaagacccagcaggccgccatggacgagggcaactcctcccaggtgtcccagaactaccccatcgtgcagaacgcccagggccagatggtgcaccaggccatctccccccgcaccctgaacgcctgggtgaaggtggtggaggagaaggccttctcccccgaggtgatccccatgttctccgccctgtccgagggcgccaccccccaggacctgaacaccatgctgaacaccgtgggcggccaccaggccgccatgcagatgctgaaggacaccatcaacgaggaggccgccgagtgggaccgcatgcacccccagcaggccggccccatcccccccggccagatccgcgagccccgcggctccgacatcgccggcaccacctccaccctgcaggagcagatccgctggatgacctccaacccccccatccccgtgggcgagatctacaagcgctggatcatcctgggcctgaacaagatcgtgcgcatgtactcccccgtgtccatcctggacatccgccagggccccaaggagcccttccgcgactacgtggaccgcttcttcaagaccctgcgcgccgagcaggccacccaggaggtgaagggctggatgaccgacaccctgctggtgcagaacgccaaccccgactgcaagaccatcctgcgcgccctgggccccggcgccaccctggaggagatgatgaccgcctgccagggcgtgggcggcccctcccacaaggcccgcgtgctggccgaggccatgtcccaggcctccggcgccgccgccgccatcatgatgcagaagtccaacttcaagggcccccgccgcaccatcaagtgcttcaactgcggcaaggagggccacctggcccgcaactgccgcgccccccgcaagaagggctgctggaagtgcggcaaggagggccaccagatgaaggactgcaccgagcgccaggccaacttcctgggcaagatctggccctccaacaagggccgccccggcaacttcctgcagaaccgccccgagcccaccgccccccccgccgagtccttcggcttcggcgaggagatcgccccctcccccaagcaggagcagaaggagaaggagctgtaccccctggcctccctgaagtccctgttcggctccgacccctaa

SEQ ID NO: 137 - protein, 499 aa, Human immunodeficiency virus
MGARASVLSGGKLDAWEKIRLRPGGKKKYRLKHLVWASRELERFALNPGLLETAEGCLQIIEQLQPAIKTGTEELQSLFNTVAVLYCVHQRIDVKDTKEALGKIEEIQNKSQQKTQQAAADKEKDNKVSQNYPIVQNAQGQMVHQAISPRTLNAWVKVVEEKAFSPEVIPMFSALSEGATPQDLNAMLNTVGGHQAAMQMLKDTINEEAAEWDRLHPVHAGPIPPGQMREPRGSDIAGTTSTLQEQIAWMTGNPPIPVGDIYKRWIILGLNKIVRMYSPVSILDIKQGPKEPFRDYVDRFFKTLRAEQATQDVKNWMTDTLLVQNANPDCKTILRALGQGASIEEMMTACQGVGGPSHKARVLAEAMSQVTNANAAIMMQKGNFKGPRKIVKCFNCGKEGHIARNCRAPRKKGCWKCGREGHQMKDCTERQANFLGKIWPSSKGRPGNFLQSRPEPTAPPAESFGFGEEMTPSPKQELKDKEPPLASLRSLFGNDPLSQ

SEQ ID NO: 138 - DNA, 1500 bp, Human immunodeficiency virus
atgggcgcccgcgcctccgtgctgtccggcggcaagctggacgcctgggagaagatccgcctgcgccccggcggcaagaagaagtaccgcctgaagcacctggtgtgggcctcccgcgagctggagcgcttcgccctgaaccccggcctgctggagaccgccgagggctgcctgcagatcatcgagcagctgcagcccgccatcaagaccggcaccgaggagctgcagtccctgttcaacaccgtggccgtgctgtactgcgtgcaccagcgcatcgacgtgaaggacaccaaggaggccctgggcaagatcgaggagatccagaacaagtcccagcagaagacccagcaggccgccgccgacaaggagaaggacaacaaggtgtcccagaactaccccatcgtgcagaacgcccagggccagatggtgcaccaggccatctccccccgcaccctgaacgcctgggtgaaggtggtggaggagaaggccttctcccccgaggtgatccccatgttctccgccctgtccgagggcgccaccccccaggacctgaacgccatgctgaacaccgtgggcggccaccaggccgccatgcagatgctgaaggacaccatcaacgaggaggccgccgagtgggaccgcctgcaccccgtgcacgccggccccatcccccccggccagatgcgcgagccccgcggctccgacatcgccggcaccacctccaccctgcaggagcagatcgcctggatgaccggcaacccccccatccccgtgggcgacatctacaagcgctggatcatcctgggcctgaacaagatcgtgcgcatgtactcccccgtgtccatcctggacatcaagcagggccccaaggagcccttccgcgactacgtggaccgcttcttcaagaccctgcgcgccgagcaggccacccaggacgtgaagaactggatgaccgacaccctgctggtgcagaacgccaaccccgactgcaagaccatcctgcgcgccctgggccagggcgcctccatcgaggagatgatgaccgcctgccagggcgtgggcggcccctcccacaaggcccgcgtgctggccgaggccatgtcccaggtgaccaacgccaacgccgccatcatgatgcagaagggcaacttcaagggcccccgcaagatcgtgaagtgcttcaactgcggcaaggagggccacatcgcccgcaactgccgcgccccccgcaagaagggctgctggaagtgcggccgcgagggccaccagatgaaggactgcaccgagcgccaggccaacttcctgggcaagatctggccctcctccaagggccgccccggcaacttcctgcagtcccgccccgagcccaccgccccccccgccgagtccttcggcttcggcgaggagatgaccccctcccccaagcaggagctgaaggacaaggagccccccctggcctccctgcgctccctgttcggcaacgaccccctgtcccagtaa

SEQ ID NO: 139 - protein, 495 aa, Human immunodeficiency virus
MGARASVLSGGKLDTWEKIRLRPGGKKKYRLKHLVWASRELERFALNPSLLETTEGCRQIIRQLQPSLQTGSEELKSLFNTVATLYCVHQRIEVRDTKEALDKLEEEQNKSQQKTQQETADKGVSQNYPIVQNLQGQMVHQALSPRTLNAWVKVIEEKAFSPEVIPMFSALSEGATPQDLNTMLNTVGGHQAAMQMLKDTINEEAAEWDRLHPVHAGPIPPGQMREPRGSDIAGTTSTLQEQITWMTSNPPVPVGEIYKRWIILGLNKIVRMYSPVSILDIRQGPKEPFRDYVDRFFKTLRAEQATQEVKNWMTDTLLVQNANPDCKTILKALGPGASLEEMMTACQGVGGPGHKARILAEAMSQVTNTAVMMQRGNFKGQRKIIKCFNCGKEGHIARNCRAPRKKGCWKCGKEGHQMKDCTERQANFLGKIWPSNKGRPGNFLQSRPEPTAPPAESFGFGEEITPSPRQETKDKEQGPPLTSLKSLFGNDPLSQ

SEQ ID NO: 140 - DNA, 1488 bp, Human immunodeficiency virus
atgggcgcccgcgcctccgtgctgtccggcggcaagctggacacctgggagaagatccgcctgcgccccggcggcaagaagaagtaccgcctgaagcacctggtgtgggcctcccgcgagctggagcgcttcgccctgaacccctccctgctggagaccaccgagggctgccgccagatcatccgccagctgcagccctccctgcagaccggctccgaggagctgaagtccctgttcaacaccgtggccaccctgtactgcgtgcaccagcgcatcgaggtgcgcgacaccaaggaggccctggacaagctggaggaggagcagaacaagtcccagcagaagacccagcaggagaccgccgacaagggcgtgtcccagaactaccccatcgtgcagaacctgcagggccagatggtgcaccaggccctgtccccccgcaccctgaacgcctgggtgaaggtgatcgaggagaaggccttctcccccgaggtgatccccatgttctccgccctgtccgagggcgccaccccccaggacctgaacaccatgctgaacaccgtgggcggccaccaggccgccatgcagatgctgaaggacaccatcaacgaggaggccgccgagtgggaccgcctgcaccccgtgcacgccggccccatcccccccggccagatgcgcgagccccgcggctccgacatcgccggcaccacctccaccctgcaggagcagatcacctggatgacctccaacccccccgtgcccgtgggcgagatctacaagcgctggatcatcctgggcctgaacaagatcgtgcgcatgtactcccccgtgtccatcctggacatccgccagggccccaaggagcccttccgcgactacgtggaccgcttcttcaagaccctgcgcgccgagcaggccacccaggaggtgaagaactggatgaccgacaccctgctggtgcagaacgccaaccccgactgcaagaccatcctgaaggccctgggccccggcgcctccctggaggagatgatgaccgcctgccagggcgtgggcggccccggccacaaggcccgcatcctggccgaggccatgtcccaggtgaccaacaccgccgtgatgatgcagcgcggcaacttcaagggccagcgcaagatcatcaagtgcttcaactgcggcaaggagggccacatcgcccgcaactgccgcgccccccgcaagaagggctgctggaagtgcggcaaggagggccaccagatgaaggactgcaccgagcgccaggccaacttcctgggcaagatctggccctccaacaagggccgccccggcaacttcctgcagtcccgccccgagcccaccgccccccccgccgagtccttcggcttcggcgaggagatcaccccctccccccgccaggagaccaaggacaaggagcagggcccccccctgacctccctgaagtccctgttcggcaacgaccccctgtcccagtaa

SEQ ID NO: 141 - protein, 498 aa, Human immunodeficiency virus
MGARASVLSGGKLDAWEKIRLRPGGKKKYRMKHLVWASRELERFALNPGLLETAEGCQQIIEQLQSTLKTGSEELKSLFNTVATLWCVHQRIEVKDTKEALDKIEEVQNKSQQKTQQAAAGTGSSSKVSQNYPIVQNAQGQMVHQPLSPRTLNAWVKVVEEKGFNPEVIPMFSALSEGATPQDLNMMLNIVGGHQAAMQMLKETINEEAAEWDRVHPVHAGPIPPGQMREPRGSDIAGTTSTLQEQIGWMTNNPPIPVGDIYKRWIILGLNKIVRMYSPVSILDIRQGPKEPFRDYVDRFYKTLRAEQATQEVKNWMTETLLVQNANPDCKSILKALGTGATLEEMMTACQGVGGPSHKARVLAEAMSQAQHANIMMQRGNFKGQKRIKCFNCGKEGHLARNCRAPRKKGCWKCGKEGHQMKDCTERQANFLGKIWPSNKGRPGNFPQSRPEPTAPPAENWGMGEEITSLPKQEQKDKEHPPPLVSLKSLFGNDPLSQ

SEQ ID NO: 142 - DNA, 1497 bp, Human immunodeficiency virus
atgggcgcccgcgcctccgtgctgtccggcggcaagctggacgcctgggagaagatccgcctgcgccccggcggcaagaagaagtaccgcatgaagcacctggtgtgggcctcccgcgagctggagcgcttcgccctgaaccccggcctgctggagaccgccgagggctgccagcagatcatcgagcagctgcagtccaccctgaagaccggctccgaggagctgaagtccctgttcaacaccgtggccaccctgtggtgcgtgcaccagcgcatcgaggtgaaggacaccaaggaggccctggacaagatcgaggaggtgcagaacaagtcccagcagaagacccagcaggccgccgccggcaccggctcctcctccaaggtgtcccagaactaccccatcgtgcagaacgcccagggccagatggtgcaccagcccctgtccccccgcaccctgaacgcctgggtgaaggtggtggaggagaagggcttcaaccccgaggtgatccccatgttctccgccctgtccgagggcgccaccccccaggacctgaacatgatgctgaacatcgtgggcggccaccaggccgccatgcagatgctgaaggagaccatcaacgaggaggccgccgagtgggaccgcgtgcaccccgtgcacgccggccccatcccccccggccagatgcgcgagccccgcggctccgacatcgccggcaccacctccaccctgcaggagcagatcggctggatgaccaacaacccccccatccccgtgggcgacatctacaagcgctggatcatcctgggcctgaacaagatcgtgcgcatgtactcccccgtgtccatcctggacatccgccagggccccaaggagcccttccgcgactacgtggaccgcttctacaagaccctgcgcgccgagcaggccacccaggaggtgaagaactggatgaccgagaccctgctggtgcagaacgccaaccccgactgcaagtccatcctgaaggccctgggcaccggcgccaccctggaggagatgatgaccgcctgccagggcgtgggcggcccctcccacaaggcccgcgtgctggccgaggccatgtcccaggcccagcacgccaacatcatgatgcagcgcggcaacttcaagggccagaagcgcatcaagtgcttcaactgcggcaaggagggccacctggcccgcaactgccgcgccccccgcaagaagggctgctggaagtgcggcaaggagggccaccagatgaaggactgcaccgagcgccaggccaacttcctgggcaagatctggccctccaacaagggccgccccggcaacttcccccagtcccgccccgagcccaccgccccccccgccgagaactggggcatgggcgaggagatcacctccctgcccaagcaggagcagaaggacaaggagcaccccccccccctggtgtccctgaagtccctgttcggcaacgaccccctgtcccagtaa

SEQ ID NO: 143 - protein, 492 aa, Human immunodeficiency virus
MGARASVLSGGKLDAWEKIRLRPGGKKKYRLKHLVWASRELERFALNPGLLETAEGCQQIMEQLQSALRTGSEELKSLYNTVATLWCVHQRIDIKDTKEALDKIEEVQNKSKQKTQQAAAATGSSSQNYPIVQNAQGQMTHQSMSPRTLNAWVKVIEEKAFSPEVIPMFSALSEGATPQDLNMMLNIVGGHQAAMQMLKDTINEEAAEWDRVHPVHAGPIPPGQMREPRGSDIAGTTSTLQEQIGWMTSNPPIPVGEIYKRWIVLGLNKIVRMYSPVSILDIRQGPKEPFRDYVDRFFKTLRAEQATQEVKNWMTETLLVQNANPDCKSILRALGPGATLEEMMTACQGVGGPGHKARVLAEAMSQVQQSNIMMQRGNFRGQRTIKCFNCGKEGHLARNCKAPRKKGCWKCGKEGHQMKDCTERQANFLGKIWPSSKGRPGNFPQSRPEPTAPPAESFGMGEEITSSPKQEPRDKGLYPPLTSLKSLFGNDP

SEQ ID NO: 144 - DNA, 1479 bp, Human immunodeficiency virus
atgggcgcccgcgcctccgtgctgtccggcggcaagctggacgcctgggagaagatccgcctgcgccccggcggcaagaagaagtaccgcctgaagcacctggtgtgggcctcccgcgagctggagcgcttcgccctgaaccccggcctgctggagaccgccgagggctgccagcagatcatggagcagctgcagtccgccctgcgcaccggctccgaggagctgaagtccctgtacaacaccgtggccaccctgtggtgcgtgcaccagcgcatcgacatcaaggacaccaaggaggccctggacaagatcgaggaggtgcagaacaagtccaagcagaagacccagcaggccgccgccgccaccggctcctcctcccagaactaccccatcgtgcagaacgcccagggccagatgacccaccagtccatgtccccccgcaccctgaacgcctgggtgaaggtgatcgaggagaaggccttctcccccgaggtgatccccatgttctccgccctgtccgagggcgccaccccccaggacctgaacatgatgctgaacatcgtgggcggccaccaggccgccatgcagatgctgaaggacaccatcaacgaggaggccgccgagtgggaccgcgtgcaccccgtgcacgccggccccatcccccccggccagatgcgcgagccccgcggctccgacatcgccggcaccacctccaccctgcaggagcagatcggctggatgacctccaacccccccatccccgtgggcgagatctacaagcgctggatcgtgctgggcctgaacaagatcgtgcgcatgtactcccccgtgtccatcctggacatccgccagggccccaaggagcccttccgcgactacgtggaccgcttcttcaagaccctgcgcgccgagcaggccacccaggaggtgaagaactggatgaccgagaccctgctggtgcagaacgccaaccccgactgcaagtccatcctgcgcgccctgggccccggcgccaccctggaggagatgatgaccgcctgccagggcgtgggcggccccggccacaaggcccgcgtgctggccgaggccatgtcccaggtgcagcagtccaacatcatgatgcagcgcggcaacttccgcggccagcgcaccatcaagtgcttcaactgcggcaaggagggccacctggcccgcaactgcaaggccccccgcaagaagggctgctggaagtgcggcaaggagggccaccagatgaaggactgcaccgagcgccaggccaacttcctgggcaagatctggccctcctccaagggccgccccggcaacttcccccagtcccgccccgagcccaccgccccccccgccgagtccttcggcatgggcgaggagatcacctcctcccccaagcaggagccccgcgacaagggcctgtacccccccctgacctccctgaagtccctgttcggcaacgacccctaa

SEQ ID NO: 145 - protein, 498 aa, Human immunodeficiency virus
MGARASVLSGGKLDAWEKIRLRPGGKKKYRIKHLVWASRELERFALNPSLLETSEGCQQILEQLQPTLKTGSEELKSLYNTVATLYCVHQRIEIKDTKEALDKIEEIQNKSKQKTQQAATGTGSSSKVSQNYPIVQNAQGQMTHQSMSPRTLNAWVKVIEEKAFSPEVIPMFSALSEGATPQDLNMMLNIVGGHQAAMQMLKDTINEEAAEWDRLHPAQAGPFPPGQMREPRGSDIAGTTSTLQEQIGWMTSNPPIPVGDIYKRWIILGLNKIVRMYSPVSILDIRQGPKEPFRDYVDRFFKTLRAEQATQDVKNWMTETLLVQNANPDCKTILRALGSGATLEEMMTACQGVGGPGHKARVLAEAMSQVQNANIMMQKSNFRGPKRIKCFNCGKDGHLARNCRAPRKKGCWKCGKEGHQMKDCTERQANFLGRIWPSSKGRPGNFPQSRPEPSAPPAENFGMGEEITPSLKQEQKDREQHPPSISLKSLFGNDPLSQ

SEQ ID NO: 146 - DNA, 1497 bp, Human immunodeficiency virus
atgggcgcccgcgcctccgtgctgtccggcggcaagctggacgcctgggagaagatccgcctgcgccccggcggcaagaagaagtaccgcatcaagcacctggtgtgggcctcccgcgagctggagcgcttcgccctgaacccctccctgctggagacctccgagggctgccagcagatcctggagcagctgcagcccaccctgaagaccggctccgaggagctgaagtccctgtacaacaccgtggccaccctgtactgcgtgcaccagcgcatcgagatcaaggacaccaaggaggccctggacaagatcgaggagatccagaacaagtccaagcagaagacccagcaggccgccaccggcaccggctcctcctccaaggtgtcccagaactaccccatcgtgcagaacgcccagggccagatgacccaccagtccatgtccccccgcaccctgaacgcctgggtgaaggtgatcgaggagaaggccttctcccccgaggtgatccccatgttctccgccctgtccgagggcgccaccccccaggacctgaacatgatgctgaacatcgtgggcggccaccaggccgccatgcagatgctgaaggacaccatcaacgaggaggccgccgagtgggaccgcctgcaccccgcccaggccggccccttcccccccggccagatgcgcgagccccgcggctccgacatcgccggcaccacctccaccctgcaggagcagatcggctggatgacctccaacccccccatccccgtgggcgacatctacaagcgctggatcatcctgggcctgaacaagatcgtgcgcatgtactcccccgtgtccatcctggacatccgccagggccccaaggagcccttccgcgactacgtggaccgcttcttcaagaccctgcgcgccgagcaggccacccaggacgtgaagaactggatgaccgagaccctgctggtgcagaacgccaaccccgactgcaagaccatcctgcgcgccctgggctccggcgccaccctggaggagatgatgaccgcctgccagggcgtgggcggccccggccacaaggcccgcgtgctggccgaggccatgtcccaggtgcagaacgccaacatcatgatgcagaagtccaacttccgcggccccaagcgcatcaagtgcttcaactgcggcaaggacggccacctggcccgcaactgccgcgccccccgcaagaagggctgctggaagtgcggcaaggagggccaccagatgaaggactgcaccgagcgccaggccaacttcctgggccgcatctggccctcctccaagggccgccccggcaacttcccccagtcccgccccgagccctccgccccccccgccgagaacttcggcatgggcgaggagatcaccccctccctgaagcaggagcagaaggaccgcgagcagcaccccccctccatctccctgaagtccctgttcggcaacgaccccctgtcccagtaa

SEQ ID NO: 147 - protein, 500 aa, Human immunodeficiency virus
MGARASVLSGGKLDAWERIRLRPGGKKKYRLKHLVWASRELERFALNPGLLETAEGCQQLMEQLQSTLKTGSEELKSLFNTIATLWCVHQRIDVKDTKEALDKVEEMQNKSKQKTQQAAADTGGSSNVSQNYPIVQNAQGQMVHQSISPRTLNAWVKVIEEKAFSPEVIPMFSALSEGATPQDLNMMLNIVGGHQAAMQMLKDTINEEAAEWDRAHPVHAGPIPPGQMREPRGSDIAGTTSTLQEQIGWMTSNPPIPVGEIYKRWIILGLNKIVRMYSPVSILDIRQGPKEPFRDYVDRFFKCLRAEQATQEVKNWMTETLLVQNANPDCKSILKALGTGATLEEMMTACQGVGGPSHKARVLAEAMSQASNAAAAIMMQKSNFKGQRRIIKCFNCGKEGHLARNCRAPRKKGCWKCGKEGHQMKDCTERQANFLGRMWPSSKGRPGNFLQSRPEPTAPPAESLEMKEETTSSPKQEPRDKELYPLTSLKSLFGSDPLSQ

SEQ ID NO: 148 - DNA, 1503 bp, Human immunodeficiency virus
atgggcgcccgcgcctccgtgctgtccggcggcaagctggacgcctgggagcgcatccgcctgcgccccggcggcaagaagaagtaccgcctgaagcacctggtgtgggcctcccgcgagctggagcgcttcgccctgaaccccggcctgctggagaccgccgagggctgccagcagctgatggagcagctgcagtccaccctgaagaccggctccgaggagctgaagtccctgttcaacaccatcgccaccctgtggtgcgtgcaccagcgcatcgacgtgaaggacaccaaggaggccctggacaaggtggaggagatgcagaacaagtccaagcagaagacccagcaggccgccgccgacaccggcggctcctccaacgtgtcccagaactaccccatcgtgcagaacgcccagggccagatggtgcaccagtccatctccccccgcaccctgaacgcctgggtgaaggtgatcgaggagaaggccttctcccccgaggtgatccccatgttctccgccctgtccgagggcgccaccccccaggacctgaacatgatgctgaacatcgtgggcggccaccaggccgccatgcagatgctgaaggacaccatcaacgaggaggccgccgagtgggaccgcgcccaccccgtgcacgccggccccatcccccccggccagatgcgcgagccccgcggctccgacatcgccggcaccacctccaccctgcaggagcagatcggctggatgacctccaacccccccatccccgtgggcgagatctacaagcgctggatcatcctgggcctgaacaagatcgtgcgcatgtactcccccgtgtccatcctggacatccgccagggccccaaggagcccttccgcgactacgtggaccgcttcttcaagtgcctgcgcgccgagcaggccacccaggaggtgaagaactggatgaccgagaccctgctggtgcagaacgccaaccccgactgcaagtccatcctgaaggccctgggcaccggcgccaccctggaggagatgatgaccgcctgccagggcgtgggcggcccctcccacaaggcccgcgtgctggccgaggccatgtcccaggcctccaacgccgccgccgccatcatgatgcagaagtccaacttcaagggccagcgccgcatcatcaagtgcttcaactgcggcaaggagggccacctggcccgcaactgccgcgccccccgcaagaagggctgctggaagtgcggcaaggagggccaccagatgaaggactgcaccgagcgccaggccaacttcctgggccgcatgtggccctcctccaagggccgccccggcaacttcctgcagtcccgccccgagcccaccgccccccccgccgagtccctggagatgaaggaggagaccacctcctcccccaagcaggagccccgcgacaaggagctgtaccccctgacctccctgaagtccctgttcggctccgaccccctgtcccagtaa

SEQ ID NO: 149 - skipped

SEQ ID NO: 150 - protein, 497 aa, Human immunodeficiency virus
MGARASVLSGGKLDEWEKIRLRPGGKKKYRLKHLVWASRELERFALNPGLLETAEGCQQIIEQLQSALKTGSEELKSLYNTVATLYCVHQRIKVTDTKEALDKIEEIQNKSKQKAQQAAAATGNSSNLSQNYPIVQNAQGQMVHQAISPRTLNAWVKVIEEKAFSPEVIPMFSALSEGATPQDLNMMLNIVGGHQAAMQMLKDTINEEAAEWDRVHPVHAGPIPPGQMREPRGSDIAGTTSTLQEQIGWMTSNPPIPVGEIYKRWIILGLNKIVRMYSPVSILDIRQGPKEPFRDYVDRFFKTLRAEQATQEVKNWMTDTLLVQNANPDCKTILKALGPGATLEEMMTACQGVGGPGHKARVLAEAMSQASGTEAAIMMQKSNFKGPKRSIKCFNCGKEGHLARNCRAPRKKGCWKCGKEGHQMKDCTERQANFLGKIWPSNKGRPGNFLQNRPEPTAPPAESFGFGEETAPSPKQEPKEKELYPLASLKSLFGNDP

SEQ ID NO: 151 - DNA, 1494 bp, Human immunodeficiency virus
atgggcgcccgcgcctccgtgctgtccggcggcaagctggacgagtgggagaagatccgcctgcgccccggcggcaagaagaagtaccgcctgaagcacctggtgtgggcctcccgcgagctggagcgcttcgccctgaaccccggcctgctggagaccgccgagggctgccagcagatcatcgagcagctgcagtccgccctgaagaccggctccgaggagctgaagtccctgtacaacaccgtggccaccctgtactgcgtgcaccagcgcatcaaggtgaccgacaccaaggaggccctggacaagatcgaggagatccagaacaagtccaagcagaaggcccagcaggccgccgccgccaccggcaactcctccaacctgtcccagaactaccccatcgtgcagaacgcccagggccagatggtgcaccaggccatctccccccgcaccctgaacgcctgggtgaaggtgatcgaggagaaggccttctcccccgaggtgatccccatgttctccgccctgtccgagggcgccaccccccaggacctgaacatgatgctgaacatcgtgggcggccaccaggccgccatgcagatgctgaaggacaccatcaacgaggaggccgccgagtgggaccgcgtgcaccccgtgcacgccggccccatcccccccggccagatgcgcgagccccgcggctccgacatcgccggcaccacctccaccctgcaggagcagatcggctggatgacctccaacccccccatccccgtgggcgagatctacaagcgctggatcatcctgggcctgaacaagatcgtgcgcatgtactcccccgtgtccatcctggacatccgccagggccccaaggagcccttccgcgactacgtggaccgcttcttcaagaccctgcgcgccgagcaggccacccaggaggtgaagaactggatgaccgacaccctgctggtgcagaacgccaaccccgactgcaagaccatcctgaaggccctgggccccggcgccaccctggaggagatgatgaccgcctgccagggcgtgggcggccccggccacaaggcccgcgtgctggccgaggccatgtcccaggcctccggcaccgaggccgccatcatgatgcagaagtccaacttcaagggccccaagcgctccatcaagtgcttcaactgcggcaaggagggccacctggcccgcaactgccgcgccccccgcaagaagggctgctggaagtgcggcaaggagggccaccagatgaaggactgcaccgagcgccaggccaacttcctgggcaagatctggccctccaacaagggccgccccggcaacttcctgcagaaccgccccgagcccaccgccccccccgccgagtccttcggcttcggcgaggagaccgccccctcccccaagcaggagcccaaggagaaggagctgtaccccctggcctccctgaagtccctgttcggcaacgacccctaa

SEQ ID NO: 152 - protein, 495 aa, Human immunodeficiency virus
MGARASILRGGKLDKWEKIRLRPGGKKHYMLKHLVWASRELERFALNPGLLETSEGCKQIIKQLQPALQTGTEELRSLFNTVATLYCVHTEIDVRDTKEALDKIEEEQNKIQQKTQQAKEADGKVSQNYPIVQNLQGQMVHQPISPRTLNAWVKVVEEKAFSPEVIPMFSALSEGATPQDLNTMLNTVGGHQAAMQILKDTINEEAAEWDRLHPVHAGPIAPGQMREPRGSDIAGTTSNLQEQIAWMTSNPPVPVGDIYKRWIILGLNKIVRMYSPTSILDIKQGPKEPFRDYVDRFFKTLRAEQATQDVKNWMTDTLLVQNANPDCKTILRALGPGASIEEMMTACQGVGGPSHKARVLAEAMSQTNSTILMQRSNFKGSKRIVKCFNCGKEGHIARNCRAPRKKGCWKCGKEGHQMKDCTERQANFLGKIWPSHKGRPGNFLQSRPEPTAPPEESFRFGEETTTPSQKQEPIDKELYPLTSLKSLFGNDPSSQ

SEQ ID NO: 153 - DNA, 1488 bp, Human immunodeficiency virus
atgggcgcccgcgcctccatcctgcgcggcggcaagctggacaagtgggagaagatccgcctgcgccccggcggcaagaagcactacatgctgaagcacctggtgtgggcctcccgcgagctggagcgcttcgccctgaaccccggcctgctggagacctccgagggctgcaagcagatcatcaagcagctgcagcccgccctgcagaccggcaccgaggagctgcgctccctgttcaacaccgtggccaccctgtactgcgtgcacaccgagatcgacgtgcgcgacaccaaggaggccctggacaagatcgaggaggagcagaacaagatccagcagaagacccagcaggccaaggaggccgacggcaaggtgtcccagaactaccccatcgtgcagaacctgcagggccagatggtgcaccagcccatctccccccgcaccctgaacgcctgggtgaaggtggtggaggagaaggccttctcccccgaggtgatccccatgttctccgccctgtccgagggcgccaccccccaggacctgaacaccatgctgaacaccgtgggcggccaccaggccgccatgcagatcctgaaggacaccatcaacgaggaggccgccgagtgggaccgcctgcaccccgtgcacgccggccccatcgcccccggccagatgcgcgagccccgcggctccgacatcgccggcaccacctccaacctgcaggagcagatcgcctggatgacctccaacccccccgtgcccgtgggcgacatctacaagcgctggatcatcctgggcctgaacaagatcgtgcgcatgtactcccccacctccatcctggacatcaagcagggccccaaggagcccttccgcgactacgtggaccgcttcttcaagaccctgcgcgccgagcaggccacccaggacgtgaagaactggatgaccgacaccctgctggtgcagaacgccaaccccgactgcaagaccatcctgcgcgccctgggccccggcgcctccatcgaggagatgatgaccgcctgccagggcgtgggcggcccctcccacaaggcccgcgtgctggccgaggccatgtcccagaccaactccaccatcctgatgcagcgctccaacttcaagggctccaagcgcatcgtgaagtgcttcaactgcggcaaggagggccacatcgcccgcaactgccgcgccccccgcaagaagggctgctggaagtgcggcaaggagggccaccagatgaaggactgcaccgagcgccaggccaacttcctgggcaagatctggccctcccacaagggccgccccggcaacttcctgcagtcccgccccgagcccaccgccccccccgaggagtccttccgcttcggcgaggagaccaccaccccctcccagaagcaggagcccatcgacaaggagctgtaccccctgacctccctgaagtccctgttcggcaacgacccctcctcccagtaa

SEQ ID NO: 154 - protein, 491 aa, Human immunodeficiency virus
MGARASILRGGKLDKWEKIRLRPGGKKHYMLKHLVWASRELERFALNPGLLETSEGCKQIIKQLQPALQTGTEELRSLFNTVATLYCVHAEIEVRDTKEALDKIEEEQNKIQQKTQQAKEADEKVSQNYPIVQNLQGQMVHQPLSPRTLNAWVKVVEEKAFSPEVIPMFTALSEGATPQDLNTMLNTVGGHQAAMQMLKDTINEEAAEWDRLHPVHAGPVAPGQMREPRGSDIAGTTSTLQEQIGWMTNNPPIPVGEIYKRWIILGLNKIVRMYSPTSILDIKQGPKEPFRDYVDRFFKTLRAEQATQDVKNWMTDTLLVQNANPDCKTILRALGPGASLEEMMTACQGVGGPSHKARVLAEAMSQTNNTILMQRSNFKGSKRIVKCFNCGKEGHIAKNCRAPRKKGCWKCGKEGHQMKDCTERQANFLGKIWPSHKGRPGNFLQSRPEPTAPPAESFRFEETTPAPKQEPKDREPLTSLRSLFGSDPLSQ

SEQ ID NO: 155 - DNA, 1476 bp, Human immunodeficiency virus
atgggcgcccgcgcctccatcctgcgcggcggcaagctggacaagtgggagaagatccgcctgcgccccggcggcaagaagcactacatgctgaagcacctggtgtgggcctcccgcgagctggagcgcttcgccctgaaccccggcctgctggagacctccgagggctgcaagcagatcatcaagcagctgcagcccgccctgcagaccggcaccgaggagctgcgctccctgttcaacaccgtggccaccctgtactgcgtgcacgccgagatcgaggtgcgcgacaccaaggaggccctggacaagatcgaggaggagcagaacaagatccagcagaagacccagcaggccaaggaggccgacgagaaggtgtcccagaactaccccatcgtgcagaacctgcagggccagatggtgcaccagcccctgtccccccgcaccctgaacgcctgggtgaaggtggtggaggagaaggccttctcccccgaggtgatccccatgttcaccgccctgtccgagggcgccaccccccaggacctgaacaccatgctgaacaccgtgggcggccaccaggccgccatgcagatgctgaaggacaccatcaacgaggaggccgccgagtgggaccgcctgcaccccgtgcacgccggccccgtggcccccggccagatgcgcgagccccgcggctccgacatcgccggcaccacctccaccctgcaggagcagatcggctggatgaccaacaacccccccatccccgtgggcgagatctacaagcgctggatcatcctgggcctgaacaagatcgtgcgcatgtactcccccacctccatcctggacatcaagcagggccccaaggagcccttccgcgactacgtggaccgcttcttcaagaccctgcgcgccgagcaggccacccaggacgtgaagaactggatgaccgacaccctgctggtgcagaacgccaaccccgactgcaagaccatcctgcgcgccctgggccccggcgcctccctggaggagatgatgaccgcctgccagggcgtgggcggcccctcccacaaggcccgcgtgctggccgaggccatgtcccagaccaacaacaccatcctgatgcagcgctccaacttcaagggctccaagcgcatcgtgaagtgcttcaactgcggcaaggagggccacatcgccaagaactgccgcgccccccgcaagaagggctgctggaagtgcggcaaggagggccaccagatgaaggactgcaccgagcgccaggccaacttcctgggcaagatctggccctcccacaagggccgccccggcaacttcctgcagtcccgccccgagcccaccgccccccccgccgagtccttccgcttcgaggagaccacccccgcccccaagcaggagcccaaggaccgcgagcccctgacctccctgcgctccctgttcggctccgaccccctgtcccagtaa

SEQ ID NO: 156 - protein, 499 aa, Human immunodeficiency virus
MGARASVLSGGKLDEWEKIRLRPGGKKKYRLKHLVWASRELERFALNPGLLETSEGCKQIIGQLQPAIQTGSEEIKSLYNTVATLYCVHERIKVTDTKEALDKIEEEQTKSKKKAQQATADTGNSSQVSQNYPIVQNLQGQMVHQPLSPRTLNAWVKVIEEKAFSPEVIPMFSALSEGATPQDLNTMLNTVGGHQAAMQMLKETINEEAAEWDRLHPVQAGPVAPGQIREPRGSDIAGTTSTLQEQIRWMTSNPPIPVGEIYKRWIILGLNKIVRMYSPVSILDIRQGPKEPFRDYVDRFYKTLRAEQASQDVKNWMTETLLVQNANPDCKTILKALGPAATLEEMMTACQGVGGPSHKARVLAEAMSQATSGNAIMMQRGNFKGPKKIIKCFNCGKEGHIAKNCRAPRKKGCWKCGREGHQMKDCTERQANFLGKIWPSNKGRPGNFLQSRPEPTAPPAESFGFGEEITPSQKQEQKDKELHPLASLKSLFGNDPLSQ

SEQ ID NO: 157 - DNA, 1500 bp, Human immunodeficiency virus
atgggcgcccgcgcctccgtgctgtccggcggcaagctggacgagtgggagaagatccgcctgcgccccggcggcaagaagaagtaccgcctgaagcacctggtgtgggcctcccgcgagctggagcgcttcgccctgaaccccggcctgctggagacctccgagggctgcaagcagatcatcggccagctgcagcccgccatccagaccggctccgaggagatcaagtccctgtacaacaccgtggccaccctgtactgcgtgcacgagcgcatcaaggtgaccgacaccaaggaggccctggacaagatcgaggaggagcagaccaagtccaagaagaaggcccagcaggccaccgccgacaccggcaactcctcccaggtgtcccagaactaccccatcgtgcagaacctgcagggccagatggtgcaccagcccctgtccccccgcaccctgaacgcctgggtgaaggtgatcgaggagaaggccttctcccccgaggtgatccccatgttctccgccctgtccgagggcgccaccccccaggacctgaacaccatgctgaacaccgtgggcggccaccaggccgccatgcagatgctgaaggagaccatcaacgaggaggccgccgagtgggaccgcctgcaccccgtgcaggccggccccgtggcccccggccagatccgcgagccccgcggctccgacatcgccggcaccacctccaccctgcaggagcagatccgctggatgacctccaacccccccatccccgtgggcgagatctacaagcgctggatcatcctgggcctgaacaagatcgtgcgcatgtactcccccgtgtccatcctggacatccgccagggccccaaggagcccttccgcgactacgtggaccgcttctacaagaccctgcgcgccgagcaggcctcccaggacgtgaagaactggatgaccgagaccctgctggtgcagaacgccaaccccgactgcaagaccatcctgaaggccctgggccccgccgccaccctggaggagatgatgaccgcctgccagggcgtgggcggcccctcccacaaggcccgcgtgctggccgaggccatgtcccaggccacctccggcaacgccatcatgatgcagcgcggcaacttcaagggccccaagaagatcatcaagtgcttcaactgcggcaaggagggccacatcgccaagaactgccgcgccccccgcaagaagggctgctggaagtgcggccgcgagggccaccagatgaaggactgcaccgagcgccaggccaacttcctgggcaagatctggccctccaacaagggccgccccggcaacttcctgcagtcccgccccgagcccaccgccccccccgccgagtccttcggcttcggcgaggagatcaccccctcccagaagcaggagcagaaggacaaggagctgcaccccctggcctccctgaagtccctgttcggcaacgaccccctgtcccagtaa

SEQ ID NO: 158 - protein, 497 aa, Human immunodeficiency virus
MGARASVLSGGKLDAWEKIRLRPGGKKKYRLKHLVWASRELERFALNPSLLETAEGCQQIMGQLQPALGTGTEELRSLYNTVATLYCVHHRIEVKDTKEALDKIEEIQNKSKQKKQQAAADTGNSSKVSQNYPIVQNAQGQMVHQAISPRTLNAWVKVVEEKAFSPEVIPMFSALSEGATPQDLNMMLNIVGGHQAAMQMLKDTINEEAAEWDRVHPVHAGPIPPGQMREPRGSDIAGTTSTLQEQIGWMTGNPPVPVGEIYRRWIILGLNKIVRMYSPVSILDIRQGPKEPFRDYVDRFFKTLRAEQATQEVKSWMTETLLIQNANPDCKSILRALGPGATLEEMMTACQGVGGPGHKARVLAEAMSQVQQTNIMMQRSNFKGQKRIKCFNCGKEGHLARNCRAPRKKGCWKCGKEGHQMKDCTERQANFLGKIWPSSKGRPGNFLQSRPEPTAPPAESFGFGEEIAPSPKQEPKEKELYPLTSLKSLFGSDPLSQ

SEQ ID NO: 159 - DNA, 1494 bp, Human immunodeficiency virus
atgggcgcccgcgcctccgtgctgtccggcggcaagctggacgcctgggagaagatccgcctgcgccccggcggcaagaagaagtaccgcctgaagcacctggtgtgggcctcccgcgagctggagcgcttcgccctgaacccctccctgctggagaccgccgagggctgccagcagatcatgggccagctgcagcccgccctgggcaccggcaccgaggagctgcgctccctgtacaacaccgtggccaccctgtactgcgtgcaccaccgcatcgaggtgaaggacaccaaggaggccctggacaagatcgaggagatccagaacaagtccaagcagaagaagcagcaggccgccgccgacaccggcaactcctccaaggtgtcccagaactaccccatcgtgcagaacgcccagggccagatggtgcaccaggccatctccccccgcaccctgaacgcctgggtgaaggtggtggaggagaaggccttctcccccgaggtgatccccatgttctccgccctgtccgagggcgccaccccccaggacctgaacatgatgctgaacatcgtgggcggccaccaggccgccatgcagatgctgaaggacaccatcaacgaggaggccgccgagtgggaccgcgtgcaccccgtgcacgccggccccatcccccccggccagatgcgcgagccccgcggctccgacatcgccggcaccacctccaccctgcaggagcagatcggctggatgaccggcaacccccccgtgcccgtgggcgagatctaccgccgctggatcatcctgggcctgaacaagatcgtgcgcatgtactcccccgtgtccatcctggacatccgccagggccccaaggagcccttccgcgactacgtggaccgcttcttcaagaccctgcgcgccgagcaggccacccaggaggtgaagtcctggatgaccgagaccctgctgatccagaacgccaaccccgactgcaagtccatcctgcgcgccctgggccccggcgccaccctggaggagatgatgaccgcctgccagggcgtgggcggccccggccacaaggcccgcgtgctggccgaggccatgtcccaggtgcagcagaccaacatcatgatgcagcgctccaacttcaagggccagaagcgcatcaagtgcttcaactgcggcaaggagggccacctggcccgcaactgccgcgccccccgcaagaagggctgctggaagtgcggcaaggagggccaccagatgaaggactgcaccgagcgccaggccaacttcctgggcaagatctggccctcctccaagggccgccccggcaacttcctgcagtcccgccccgagcccaccgccccccccgccgagtccttcggcttcggcgaggagatcgccccctcccccaagcaggagcccaaggagaaggagctgtaccccctgacctccctgaagtccctgttcggctccgaccccctgtcccagtaa

SEQ ID NO: 160 - protein, 492 aa, Human immunodeficiency virus
MGARASVLSGGELDRWEKIRLRPGGKKKYRLKHIVWASRELERFAVNPGLLETSEGCRKIIGQLQPSLQTGSEELRSLYNTIAVLYFVHQKVEVKDTKEALDKLEEEQNKSQQKTQQAAADKGVSQNYPIVQNLQGQMVHQALSPRTLNAWVKVVEEKAFSPEVIPMFSALSEGATPQDLNTMLNTVGGHQAAMQMLKDTINEEAAEWDRLHPVHAGPIPPGQMREPRGSDIAGTTSTLQEQIQWMTSNPPVPVGEIYKRWIILGLNKIVRMYSPVSILDIRQGPKEPFRDYVDRFFKTLRAEQATQEVKGWMTDTLLVQNANPDCKTILKALGPGATLEEMMTACQGVGGPGHKARVLAEAMSQVTNTTVMMQKSNFKGQRRIVKCFNCGKEGHIAKNCRAPRKKGCWKCGREGHQMKDCTERQANFLGKIWPSNKGRPGNFLQNRPEPTAPPAESFGFGEEITPSPKQEQKDEGLYPPLASLKSLFGNDP

SEQ ID NO: 161 - DNA, 1479 bp, Human immunodeficiency virus
atgggcgcccgcgcctccgtgctgtccggcggcgagctggaccgctgggagaagatccgcctgcgccccggcggcaagaagaagtaccgcctgaagcacatcgtgtgggcctcccgcgagctggagcgcttcgccgtgaaccccggcctgctggagacctccgagggctgccgcaagatcatcggccagctgcagccctccctgcagaccggctccgaggagctgcgctccctgtacaacaccatcgccgtgctgtacttcgtgcaccagaaggtggaggtgaaggacaccaaggaggccctggacaagctggaggaggagcagaacaagtcccagcagaagacccagcaggccgccgccgacaagggcgtgtcccagaactaccccatcgtgcagaacctgcagggccagatggtgcaccaggccctgtccccccgcaccctgaacgcctgggtgaaggtggtggaggagaaggccttctcccccgaggtgatccccatgttctccgccctgtccgagggcgccaccccccaggacctgaacaccatgctgaacaccgtgggcggccaccaggccgccatgcagatgctgaaggacaccatcaacgaggaggccgccgagtgggaccgcctgcaccccgtgcacgccggccccatcccccccggccagatgcgcgagccccgcggctccgacatcgccggcaccacctccaccctgcaggagcagatccagtggatgacctccaacccccccgtgcccgtgggcgagatctacaagcgctggatcatcctgggcctgaacaagatcgtgcgcatgtactcccccgtgtccatcctggacatccgccagggccccaaggagcccttccgcgactacgtggaccgcttcttcaagaccctgcgcgccgagcaggccacccaggaggtgaagggctggatgaccgacaccctgctggtgcagaacgccaaccccgactgcaagaccatcctgaaggccctgggccccggcgccaccctggaggagatgatgaccgcctgccagggcgtgggcggccccggccacaaggcccgcgtgctggccgaggccatgtcccaggtgaccaacaccaccgtgatgatgcagaagtccaacttcaagggccagcgccgcatcgtgaagtgcttcaactgcggcaaggagggccacatcgccaagaactgccgcgccccccgcaagaagggctgctggaagtgcggccgcgagggccaccagatgaaggactgcaccgagcgccaggccaacttcctgggcaagatctggccctccaacaagggccgccccggcaacttcctgcagaaccgccccgagcccaccgccccccccgccgagtccttcggcttcggcgaggagatcaccccctcccccaagcaggagcagaaggacgagggcctgtacccccccctggcctccctgaagtccctgttcggcaacgacccctaa

SEQ ID NO: 162 - protein, 496 aa, Human immunodeficiency virus
MGARASVLSGGKLDAWEKIRLRPGGKKKYRMKHLVWASRELERFALNPDLLETAEGCQQIMGQLQPALQTGTEEIRSLFNTVATLYCVHQKIEVKDTKEALEEVEKAQKKSQKKQQAAMDEGNNSQASQNYPIVQNAQGQMVHQAISPRTLNAWVKVVEEKAFSPEVIPMFSALSEGATPQDLNTMLNTVGGHQAAMQMLKDTINEEAAEWDRMHPQQAGPIPPGQIREPRGSDIAGTTSTLQEQIRWMTSNPPIPVGEIYKRWIILGLNKIVRMYSPVSILDIRQGPKEPFRDYVDRFFKTLRAEQATQEVKGWMTDTLLVQNANPDCKTILRALGPGATLEEMMTACQGVGGPSHKARVLAEAMSQASGATIMMQKSNFKGPRRNIKCFNCGKEGHLARNCRAPRKKGCWKCGKEGHQMKDCTESKANFLGKIWPSNKGRPGNFLQNRPEPTAPPAESFGFGEEIAPSPKQEPKEKEIYPLASLKSLFGSDPSQ

SEQ ID NO: 163 - DNA, 1494 bp, Human immunodeficiency virus
atgggcgcccgcgcctccgtgctgtccggcggcaagctggacgcctgggagaagatccgcctgcgccccggcggcaagaagaagtaccgcatgaagcacctggtgtgggcctcccgcgagctggagcgcttcgccctgaaccccgacctgctggagaccgccgagggctgccagcagatcatgggccagctgcagcccgccctgcagaccggcaccgaggagatccgctccctgttcaacaccgtggccaccctgtactgcgtgcaccagaagatcgaggtgaaggacaccaaggaggccctggaggaggtggagaaggcccagaagaagtcccagaagaagcagcaggccgccatggacgagggcaacaactcccaggcctcccagaactaccccatcgtgcagaacgcccagggccagatggtgcaccaggccatctccccccgcaccctgaacgcctgggtgaaggtggtggaggagaaggccttctcccccgaggtgatccccatgttctccgccctgtccgagggcgccaccccccaggacctgaacaccatgctgaacaccgtgggcggccaccaggccgccatgcagatgctgaaggacaccatcaacgaggaggccgccgagtgggaccgcatgcacccccagcaggccggccccatcccccccggccagatccgcgagccccgcggctccgacatcgccggcaccacctccaccctgcaggagcagatccgctggatgacctccaacccccccatccccgtgggcgagatctacaagcgctggatcatcctgggcctgaacaagatcgtgcgcatgtactcccccgtgtccatcctggacatccgccagggccccaaggagcccttccgcgactacgtggaccgcttcttcaagaccctgcgcgccgagcaggccacccaggaggtgaagggctggatgaccgacaccctgctggtgcagaacgccaaccccgactgcaagaccatcctgcgcgccctgggccccggcgccaccctggaggagatgatgaccgcctgccagggcgtgggcggcccctcccacaaggcccgcgtgctggccgaggccatgtcccaggcctccggcgccaccatcatgatgcagaagtccaacttcaagggcccccgccgcaacatcaagtgcttcaactgcggcaaggagggccacctggcccgcaactgccgcgccccccgcaagaagggctgctggaagtgcggcaaggagggccaccagatgaaggactgcaccgagtccaaggccaacttcctgggcaagatctggccctccaacaagggccgccccggcaacttcctgcagaaccgccccgagcccaccgccccccccgccgagtccttcggcttcggcgaggagatcgccccctcccccaagcaggagcccaaggagaaggagatctaccccctggcctccctgaagtccctgttcggctccgacccctaatcccagtaa

SEQ ID NO: 164 - protein, 206 aa, Human immunodeficiency virus
MGGKWSKSSIVGWPAVRERIRRTPPAAEGVGAVSQDLDKHGAITSSNTAATNADCAWLEAQEEEEVGFPVRPQVPLRPMTYKGAFDLSHFLKEKGGLDGLIYSKKRQEILDLWVYHTQGYFPDWQNYTPGPGIRYPLTFGWCFKLVPVDPEEVEEANEGENNCLLHPMCQHGMEDEDREVLMWKFDSRLALRHIARELHPEFYKDC

SEQ ID NO: 165 - DNA, 621 bp, Human immunodeficiency virus
atgggcggcaagtggtccaagtcctccatcgtgggctggcccgccgtgcgcgagcgcatccgccgcaccccccccgccgccgagggcgtgggcgccgtgtcccaggacctggacaagcacggcgccatcacctcctccaacaccgccgccaccaacgccgactgcgcctggctggaggcccaggaggaggaggaggtgggcttccccgtgcgcccccaggtgcccctgcgccccatgacctacaagggcgccttcgacctgtcccacttcctgaaggagaagggcggcctggacggcctgatctactccaagaagcgccaggagatcctggacctgtgggtgtaccacacccagggctacttccccgactggcagaactacacccccggccccggcatccgctaccccctgaccttcggctggtgcttcaagctggtgcccgtggaccccgaggaggtggaggaggccaacgagggcgagaacaactgcctgctgcaccccatgtgccagcacggcatggaggacgaggaccgcgaggtgctgatgtggaagttcgactcccgcctggccctgcgccacatcgcccgcgagctgcaccccgagttctacaaggactgctaa

SEQ ID NO: 166 - protein, 206 aa, Human immunodeficiency virus
MGGKWSKSSIVGWPAVRERMRRTAPAAEGVGAVSQDLDKHGAITSSNTAATNADCAWLEAQEEEEVGFPVRPQVPLRPMTYKAAFDLSHFLKEKGGLDGLIYSKKRQEILDLWVYHTQGYFPDWQNYTPGPGIRYPLTFGWCFKLVPVDPEEVEEANEGENNCLLHPMCQHGMEDEEREVLMWKFDSRLALRHIARELHPEFYKDC

SEQ ID NO: 167 - DNA, 621 bp, Human immunodeficiency virus
atgggcggcaagtggtccaagtcctccatcgtgggctggcccgccgtgcgcgagcgcatgcgccgcaccgcccccgccgccgagggcgtgggcgccgtgtcccaggacctggacaagcacggcgccatcacctcctccaacaccgccgccaccaacgccgactgcgcctggctggaggcccaggaggaggaggaggtgggcttccccgtgcgcccccaggtgcccctgcgccccatgacctacaaggccgccttcgacctgtcccacttcctgaaggagaagggcggcctggacggcctgatctactccaagaagcgccaggagatcctggacctgtgggtgtaccacacccagggctacttccccgactggcagaactacacccccggccccggcatccgctaccccctgaccttcggctggtgcttcaagctggtgcccgtggaccccgaggaggtggaggaggccaacgagggcgagaacaactgcctgctgcaccccatgtgccagcacggcatggaggacgaggagcgcgaggtgctgatgtggaagttcgactcccgcctggccctgcgccacatcgcccgcgagctgcaccccgagttctacaaggactgctaa

SEQ ID NO: 168 - protein, 207 aa, Human immunodeficiency virus
MGGKWSKSSIVGWPDIRERIRRTPPAAKGVGAVSQDLDKYGAVTINNTAATQASCAWLEAQEEEEEVGFPVRPQVPLRPMTFKGAFDLSFFLKEKGGLDGLIYSQKRQEILDLWVYNTQGYFPDWQNYTPGPGTRFPLTFGWCFKLVPVDPDEVEEATEGENNCLLHPICQHGMDDEEKEVLMWKFDSRLARRHIALEMHPEFYKDC

SEQ ID NO: 169 - DNA, 624 bp, Human immunodeficiency virus
atgggcggcaagtggtccaagtcctccatcgtgggctggcccgacatccgcgagcgcatccgccgcaccccccccgccgccaagggcgtgggcgccgtgtcccaggacctggacaagtacggcgccgtgaccatcaacaacaccgccgccacccaggcctcctgcgcctggctggaggcccaggaggaggaggaggaggtgggcttccccgtgcgcccccaggtgcccctgcgccccatgaccttcaagggcgccttcgacctgtccttcttcctgaaggagaagggcggcctggacggcctgatctactcccagaagcgccaggagatcctggacctgtgggtgtacaacacccagggctacttccccgactggcagaactacacccccggccccggcacccgcttccccctgaccttcggctggtgcttcaagctggtgcccgtggaccccgacgaggtggaggaggccaccgagggcgagaacaactgcctgctgcaccccatctgccagcacggcatggacgacgaggagaaggaggtgctgatgtggaagttcgactcccgcctggcccgccgccacatcgccctggagatgcaccccgagttctacaaggactgctaa

SEQ ID NO: 170 - protein, 204 aa, Human immunodeficiency virus
MGGKWSKSSIVGWPEVRERMRRTPPAATGVGAVSQDLDKHGAVTSSNINHPSCVWLEAQEEEEVGFPVRPQVPLRPMTYKGALDLSHFLKEKGGLDGLIYSRKRQEILDLWVYHTQGYFPDWQNYTPGPGIRYPLTFGWCFKLVPVDPDEVEKATEGENNSLLHPICQHGMDDEEREVLKWKFDSRLALKHRAQELHPEFYKDC

SEQ ID NO: 171 - DNA, 615 bp, Human immunodeficiency virus
atgggcggcaagtggtccaagtcctccatcgtgggctggcccgaggtgcgcgagcgcatgcgccgcaccccccccgccgccaccggcgtgggcgccgtgtcccaggacctggacaagcacggcgccgtgacctcctccaacatcaaccacccctcctgcgtgtggctggaggcccaggaggaggaggaggtgggcttccccgtgcgcccccaggtgcccctgcgccccatgacctacaagggcgccctggacctgtcccacttcctgaaggagaagggcggcctggacggcctgatctactcccgcaagcgccaggagatcctggacctgtgggtgtaccacacccagggctacttccccgactggcagaactacacccccggccccggcatccgctaccccctgaccttcggctggtgcttcaagctggtgcccgtggaccccgacgaggtggagaaggccaccgagggcgagaacaactccctgctgcaccccatctgccagcacggcatggacgacgaggagcgcgaggtgctgaagtggaagttcgactcccgcctggccctgaagcaccgcgcccaggagctgcaccccgagttctacaaggactgctaa

SEQ ID NO: 172 - protein, 206 aa, Human immunodeficiency virus
MGGKWSKSSIVGWPEVRERMRRTPPAAKGVGAVSQDLDKHGAVTSSNTAANNPGCAWLEAQEEEEVGFPVRPQVPLRPMTYKGAFDLSHFLKEKGGLDGLIYSKKRQEILDLWVYHTQGYFPDWQNYTPGPGIRYPLTFGWCFKLVPVDPAEVEEATEGENNSLLHPICQHGMDDEEREVLMWKFDSRLALKHRARELHPEFYKDC

SEQ ID NO: 173 - DNA, 621 bp, Human immunodeficiency virus
atgggcggcaagtggtccaagtcctccatcgtgggctggcccgaggtgcgcgagcgcatgcgccgcaccccccccgccgccaagggcgtgggcgccgtgtcccaggacctggacaagcacggcgccgtgacctcctccaacaccgccgccaacaaccccggctgcgcctggctggaggcccaggaggaggaggaggtgggcttccccgtgcgcccccaggtgcccctgcgccccatgacctacaagggcgccttcgacctgtcccacttcctgaaggagaagggcggcctggacggcctgatctactccaagaagcgccaggagatcctggacctgtgggtgtaccacacccagggctacttccccgactggcagaactacacccccggccccggcatccgctaccccctgaccttcggctggtgcttcaagctggtgcccgtggaccccgccgaggtggaggaggccaccgagggcgagaacaactccctgctgcaccccatctgccagcacggcatggacgacgaggagcgcgaggtgctgatgtggaagttcgactcccgcctggccctgaagcaccgcgcccgcgagctgcaccccgagttctacaaggactgctaa

SEQ ID NO: 174 - protein, 207 aa, Human immunodeficiency virus
MGGKWSKSSIVGWPAIRERMRKRTPPAAEGVGAVSQDLATRGAVTSSNTAATNPDCAWLEAQEEEEVGFPVRPQVPLRPMTFKGAFDLSHFLKEKGGLDGLIYSQKRQDILDLWVYHTQGYFPDWQNYTPGPGTRYPLTFGWCFKLVPVDPSEVEEATEGENNSLLHPICQHGIEDPEREVLRWKFDSRLALRHRARELHPEFYKDC

SEQ ID NO: 175 - DNA, 624 bp, Human immunodeficiency virus
atgggcggcaagtggtccaagtcctccatcgtgggctggcccgccatccgcgagcgcatgcgcaagcgcaccccccccgccgccgagggcgtgggcgccgtgtcccaggacctggccacccgcggcgccgtgacctcctccaacaccgccgccaccaaccccgactgcgcctggctggaggcccaggaggaggaggaggtgggcttccccgtgcgcccccaggtgcccctgcgccccatgaccttcaagggcgccttcgacctgtcccacttcctgaaggagaagggcggcctggacggcctgatctactcccagaagcgccaggacatcctggacctgtgggtgtaccacacccagggctacttccccgactggcagaactacacccccggccccggcacccgctaccccctgaccttcggctggtgcttcaagctggtgcccgtggacccctccgaggtggaggaggccaccgagggcgagaacaactccctgctgcaccccatctgccagcacggcatcgaggaccccgagcgcgaggtgctgcgctggaagttcgactcccgcctggccctgcgccaccgcgcccgcgagctgcaccccgagttctacaaggactgctaa

SEQ ID NO: 176 - protein, 206 aa, Human immunodeficiency virus
MGGKWSKRSVVGWPTVRERMRRAEPAADGVGAVSRDLEKHGAITSSNTAANNADCAWLEAQEEEEVGFPVRPQVPLRPMTYKGALDLSHFLKEKGGLEGLIYSQKRQDILDLWVYHTQGYFPDWQNYTPGPGIRYPLTFGWCFKLVPVEPEKVEEANEGENNSLLHPMSLHGMDDPEREVLVWKFDSRLAFHHMARELHPEYYKDC

SEQ ID NO: 177 - DNA, 621 bp, Human immunodeficiency virus
atgggcggcaagtggtccaagcgctccgtggtgggctggcccaccgtgcgcgagcgcatgcgccgcgccgagcccgccgccgacggcgtgggcgccgtgtcccgcgacctggagaagcacggcgccatcacctcctccaacaccgccgccaacaacgccgactgcgcctggctggaggcccaggaggaggaggaggtgggcttccccgtgcgcccccaggtgcccctgcgccccatgacctacaagggcgccctggacctgtcccacttcctgaaggagaagggcggcctggagggcctgatctactcccagaagcgccaggacatcctggacctgtgggtgtaccacacccagggctacttccccgactggcagaactacacccccggccccggcatccgctaccccctgaccttcggctggtgcttcaagctggtgcccgtggagcccgagaaggtggaggaggccaacgagggcgagaacaactccctgctgcaccccatgtccctgcacggcatggacgaccccgagcgcgaggtgctggtgtggaagttcgactcccgcctggccttccaccacatggcccgcgagctgcaccccgagtactacaaggactgctaa

SEQ ID NO: 178 - protein, 206 aa, Human immunodeficiency virus
MGGKWSKSSMGGWPAVRERMKRAEPAADGVGAVSRDLEKHGAITSSNTAATNADCAWLEAQEEEEVGFPVRPQVPLRPMTYKAALDLSHFLKEKGGLEGLIYSQKRQDILDLWVYHTQGYFPDWQNYTPGPGIRYPLTFGWCFKLVPVEPEKVEEATEGENNSLLHPMCQHGMDDPEKEVLVWKFDSRLAFHHMARELHPEYYKDC

SEQ ID NO: 179 - DNA, 621 bp, Human immunodeficiency virus
atgggcggcaagtggtccaagtcctccatgggcggctggcccgccgtgcgcgagcgcatgaagcgcgccgagcccgccgccgacggcgtgggcgccgtgtcccgcgacctggagaagcacggcgccatcacctcctccaacaccgccgccaccaacgccgactgcgcctggctggaggcccaggaggaggaggaggtgggcttccccgtgcgcccccaggtgcccctgcgccccatgacctacaaggccgccctggacctgtcccacttcctgaaggagaagggcggcctggagggcctgatctactcccagaagcgccaggacatcctggacctgtgggtgtaccacacccagggctacttccccgactggcagaactacacccccggccccggcatccgctaccccctgaccttcggctggtgcttcaagctggtgcccgtggagcccgagaaggtggaggaggccaccgagggcgagaacaactccctgctgcaccccatgtgccagcacggcatggacgaccccgagaaggaggtgctggtgtggaagttcgactcccgcctggccttccaccacatggcccgcgagctgcaccccgagtactacaaggactgctaa

SEQ ID NO: 180 - protein, 206 aa, Human immunodeficiency virus
MGGKWSKSSIVGWPKVRERIRQTPPAATGVGAASQDLDRHGAITSSNTAATNADCAWLEAQEEEEVGFPVRPQVPLRPMTYKAAVDLSHFLKEKGGLEGLIYSKKRQEILDLWVYHTQGFFPDWQNYTPGPGTRFPLTFGWCFKLVPMDPAEVEEANEGENNSLLHPICQHGMEDEDREVLVWRFDSSLAFKHRARELHPEFYKDC

SEQ ID NO: 181 - DNA, 621 bp, Human immunodeficiency virus
atgggcggcaagtggtccaagtcctccatcgtgggctggcccaaggtgcgcgagcgcatccgccagaccccccccgccgccaccggcgtgggcgccgcctcccaggacctggaccgccacggcgccatcacctcctccaacaccgccgccaccaacgccgactgcgcctggctggaggcccaggaggaggaggaggtgggcttccccgtgcgcccccaggtgcccctgcgccccatgacctacaaggccgccgtggacctgtcccacttcctgaaggagaagggcggcctggagggcctgatctactccaagaagcgccaggagatcctggacctgtgggtgtaccacacccagggcttcttccccgactggcagaactacacccccggccccggcacccgcttccccctgaccttcggctggtgcttcaagctggtgcccatggaccccgccgaggtggaggaggccaacgagggcgagaacaactccctgctgcaccccatctgccagcacggcatggaggacgaggaccgcgaggtgctggtgtggcgcttcgactcctccctggccttcaagcaccgcgcccgcgagctgcaccccgagttctacaaggactgctaa

SEQ ID NO: 182 - protein, 207 aa, Human immunodeficiency virus
MGGKWSKSSIVGWPAVRERIRRTEPAAEGVGAASQDLDKHGALTSSNTATNNADCAWLEAQEEEEEVGFPVRPQVPLRPMTYKAAFDLSFFLKEKGGLEGLIYSKKRQEILDLWVYHTQGYFPDWQNYTPGPGVRYPLTFGWCFKLVPVDPREVEEANEGENNCLLHPMSQHGMEDEDREVLKWKFDSHLARRHMARELHPEYYKDC

SEQ ID NO: 183 - DNA, 624 bp, Human immunodeficiency virus
atgggcggcaagtggtccaagtcctccatcgtgggctggcccgccgtgcgcgagcgcatccgccgcaccgagcccgccgccgagggcgtgggcgccgcctcccaggacctggacaagcacggcgccctgacctcctccaacaccgccaccaacaacgccgactgcgcctggctggaggcccaggaggaggaggaggaggtgggcttccccgtgcgcccccaggtgcccctgcgccccatgacctacaaggccgccttcgacctgtccttcttcctgaaggagaagggcggcctggagggcctgatctactccaagaagcgccaggagatcctggacctgtgggtgtaccacacccagggctacttccccgactggcagaactacacccccggccccggcgtgcgctaccccctgaccttcggctggtgcttcaagctggtgcccgtggacccccgcgaggtggaggaggccaacgagggcgagaacaactgcctgctgcaccccatgtcccagcacggcatggaggacgaggaccgcgaggtgctgaagtggaagttcgactcccacctggcccgccgccacatggcccgcgagctgcaccccgagtactacaaggactgctaa

SEQ ID NO: 184 - protein, 207 aa, Human immunodeficiency virus
MGGKWSKSSIVGWPAVRERMRRTEPAAEGVGAASQDLDKHGALTSSNTAANNADCAWLEAQEEEEEVGFPVRPQVPLRPMTYKAAFDLSFFLKEKGGLDGLIYSKKRQEILDLWVYHTQGYFPDWQNYTPGPGVRYPLTFGWCFKLVPVDPREVEEANEGENNCLLHPMSQHGMEDEDREVLKWKFDSHLARRHMARELHPEYYKDC

SEQ ID NO: 185 - DNA, 624 bp, Human immunodeficiency virus
atgggcggcaagtggtccaagtcctccatcgtgggctggcccgccgtgcgcgagcgcatgcgccgcaccgagcccgccgccgagggcgtgggcgccgcctcccaggacctggacaagcacggcgccctgacctcctccaacaccgccgccaacaacgccgactgcgcctggctggaggcccaggaggaggaggaggaggtgggcttccccgtgcgcccccaggtgcccctgcgccccatgacctacaaggccgccttcgacctgtccttcttcctgaaggagaagggcggcctggacggcctgatctactccaagaagcgccaggagatcctggacctgtgggtgtaccacacccagggctacttccccgactggcagaactacacccccggccccggcgtgcgctaccccctgaccttcggctggtgcttcaagctggtgcccgtggacccccgcgaggtggaggaggccaacgagggcgagaacaactgcctgctgcaccccatgtcccagcacggcatggaggacgaggaccgcgaggtgctgaagtggaagttcgactcccacctggcccgccgccacatggcccgcgagctgcaccccgagtactacaaggactgctaa

SEQ ID NO: 186 - protein, 207 aa, Human immunodeficiency virus
MGGKWSKSSIVGWPAIRERIRRTEPAADGVGAVSRDLEKHGAITSSNTAATNADCAWLEAQEEDEEVGFPVRPQVPLRPMTYKAALDLSHFLKEKGGLEGLVWSQKRQEILDLWVYNTQGFFPDWQNYTPGPGIRYPLTFGWCFELVPVDPEEVEEATEGENNCLLHPMCQHGMEDPEREVLMWRFNSRLAFEHKARVLHPEFYKDC

SEQ ID NO: 187 - DNA, 624 bp, Human immunodeficiency virus
atgggcggcaagtggtccaagtcctccatcgtgggctggcccgccatccgcgagcgcatccgccgcaccgagcccgccgccgacggcgtgggcgccgtgtcccgcgacctggagaagcacggcgccatcacctcctccaacaccgccgccaccaacgccgactgcgcctggctggaggcccaggaggaggacgaggaggtgggcttccccgtgcgcccccaggtgcccctgcgccccatgacctacaaggccgccctggacctgtcccacttcctgaaggagaagggcggcctggagggcctggtgtggtcccagaagcgccaggagatcctggacctgtgggtgtacaacacccagggcttcttccccgactggcagaactacacccccggccccggcatccgctaccccctgaccttcggctggtgcttcgagctggtgcccgtggaccccgaggaggtggaggaggccaccgagggcgagaacaactgcctgctgcaccccatgtgccagcacggcatggaggaccccgagcgcgaggtgctgatgtggcgcttcaactcccgcctggccttcgagcacaaggcccgcgtgctgcaccccgagttctacaaggactgctaa

SEQ ID NO: 188 - protein, 205 aa, Human immunodeficiency virus
MGGKWSKSSIVGWPAVRERMRPTPPAAEGVGAVSQDLERRGAITSSNTGATNPDLAWLEAQEEEEVGFPVRPQVPLRPMTYKGAVDLSHFLKEKGGLEGLIYSKKRQEILDLWVYHTQGYFPDWQNYTPGPGIRYPLTFGWCFKLVPVDPEEVEKANEGENNCLLHPMSQHGMEDEDREVLIWKFDSRLALRHIARERHPEFYQD

SEQ ID NO: 189 - DNA, 618 bp, Human immunodeficiency virus
atgggcggcaagtggtccaagtcctccatcgtgggctggcccgccgtgcgcgagcgcatgcgccccaccccccccgccgccgagggcgtgggcgccgtgtcccaggacctggagcgccgcggcgccatcacctcctccaacaccggcgccaccaaccccgacctggcctggctggaggcccaggaggaggaggaggtgggcttccccgtgcgcccccaggtgcccctgcgccccatgacctacaagggcgccgtggacctgtcccacttcctgaaggagaagggcggcctggagggcctgatctactccaagaagcgccaggagatcctggacctgtgggtgtaccacacccagggctacttccccgactggcagaactacacccccggccccggcatccgctaccccctgaccttcggctggtgcttcaagctggtgcccgtggaccccgaggaggtggagaaggccaacgagggcgagaacaactgcctgctgcaccccatgtcccagcacggcatggaggacgaggaccgcgaggtgctgatctggaagttcgactcccgcctggccctgcgccacatcgcccgcgagcgccaccccgagttctaccaggactaa

SEQ ID NO: 190 - protein, 205 aa, Human immunodeficiency virus
MGGKWSKSSIVGWPTIRERIRRTPVAAEGVGAVSQDLDKHGAITSSNTRATNADLAWLEAQEDEEVGFPVRPQVPLRPMTYKAAFDLSHFLKEKGGLEGLIYSKKRQEILDLWVYHTQGYFPDWQNYTPGPGTRYPLTFGWCFKLVPVDPEEVEKANEGENNCLLHPMSLHGMEDEDREVLKWKFDSRLALRHIARERHPEYYKD

SEQ ID NO: 191 - DNA, 618 bp, Human immunodeficiency virus
atgggcggcaagtggtccaagtcctccatcgtgggctggcccaccatccgcgagcgcatccgccgcacccccgtggccgccgagggcgtgggcgccgtgtcccaggacctggacaagcacggcgccatcacctcctccaacacccgcgccaccaacgccgacctggcctggctggaggcccaggaggacgaggaggtgggcttccccgtgcgcccccaggtgcccctgcgccccatgacctacaaggccgccttcgacctgtcccacttcctgaaggagaagggcggcctggagggcctgatctactccaagaagcgccaggagatcctggacctgtgggtgtaccacacccagggctacttccccgactggcagaactacacccccggccccggcacccgctaccccctgaccttcggctggtgcttcaagctggtgcccgtggaccccgaggaggtggagaaggccaacgagggcgagaacaactgcctgctgcaccccatgtccctgcacggcatggaggacgaggaccgcgaggtgctgaagtggaagttcgactcccgcctggccctgcgccacatcgcccgcgagcgccaccccgagtactacaaggactaa

SEQ ID NO: 192 - protein, 207 aa, Human immunodeficiency virus
MGGKWSKSSIVGWPEVRERIRQTPPAAEGVGAVSQDLARHGAITSSNTAANNPDCAWLEAQEEDSEVGFPVRPQVPLRPMTYKGAFDLSFFLKEKGGLDGLIYSKKRQDILDLWVYNTQGFFPDWQNYTPGPGTRFPLTFGWCFKLVPMDPAEVEEANKGENNSLLHPICQHGMEDEDREVLVWRFDSSLARRHIARELHPEYYKDC

SEQ ID NO: 193 - DNA, 624 bp, Human immunodeficiency virus
atgggcggcaagtggtccaagtcctccatcgtgggctggcccgaggtgcgcgagcgcatccgccagaccccccccgccgccgagggcgtgggcgccgtgtcccaggacctggcccgccacggcgccatcacctcctccaacaccgccgccaacaaccccgactgcgcctggctggaggcccaggaggaggactccgaggtgggcttccccgtgcgcccccaggtgcccctgcgccccatgacctacaagggcgccttcgacctgtccttcttcctgaaggagaagggcggcctggacggcctgatctactccaagaagcgccaggacatcctggacctgtgggtgtacaacacccagggcttcttccccgactggcagaactacacccccggccccggcacccgcttccccctgaccttcggctggtgcttcaagctggtgcccatggaccccgccgaggtggaggaggccaacaagggcgagaacaactccctgctgcaccccatctgccagcacggcatggaggacgaggaccgcgaggtgctggtgtggcgcttcgactcctccctggcccgccgccacatcgcccgcgagctgcaccccgagtactacaaggactgctaa

SEQ ID NO: 194 - protein, 207 aa, Human immunodeficiency virus
MGGKWSKSSIGGWPAIRERIRRAEPAAEGVGAVSRDLDRRGAVTINNTASTNPDSAWLEAQEEEEEVGFPVRPQVPLRPMTYKGAFDLSHFLKEKGGLEGLIYSKKRQEILDLWVYNTQGYFPDWQNYTPGPGERYPLTFGWCFKLVPVDPQEVEKANEGENNSLLHPICQHGMEDEEREVLMWKFDSRLAFRHIARELHPEFYKDC

SEQ ID NO: 195 - DNA, 624 bp, Human immunodeficiency virus
atgggcggcaagtggtccaagtcctccatcggcggctggcccgccatccgcgagcgcatccgccgcgccgagcccgccgccgagggcgtgggcgccgtgtcccgcgacctggaccgccgcggcgccgtgaccatcaacaacaccgcctccaccaaccccgactccgcctggctggaggcccaggaggaggaggaggaggtgggcttccccgtgcgcccccaggtgcccctgcgccccatgacctacaagggcgccttcgacctgtcccacttcctgaaggagaagggcggcctggagggcctgatctactccaagaagcgccaggagatcctggacctgtgggtgtacaacacccagggctacttccccgactggcagaactacacccccggccccggcgagcgctaccccctgaccttcggctggtgcttcaagctggtgcccgtggacccccaggaggtggagaaggccaacgagggcgagaacaactccctgctgcaccccatctgccagcacggcatggaggacgaggagcgcgaggtgctgatgtggaagttcgactcccgcctggccttccgccacatcgcccgcgagctgcaccccgagttctacaaggactgctaa

SEQ ID NO: 196 - protein, 204 aa, Human immunodeficiency virus
MGGKWSKSSIVGWPQVRERIKQTPPATEGVGAVSQDLDKHGAVTSSNMNNADCVWLRAQEEEEVGFPVRPQVPLRPMTYKGAFDLSFFLKEKGGLDGLIYSKKRQEILDLWVYNTQGFFPDWQNYTPGPGIRYPLCFGWCFKLVPVDPREVEEDNKGENNCLLHPMSQHGIEDEEREVLMWKFDSALARKHIARELHPEYYKDC

SEQ ID NO: 197 - DNA, 615 bp, Human immunodeficiency virus
atgggcggcaagtggtccaagtcctccatcgtgggctggccccaggtgcgcgagcgcatcaagcagaccccccccgccaccgagggcgtgggcgccgtgtcccaggacctggacaagcacggcgccgtgacctcctccaacatgaacaacgccgactgcgtgtggctgcgcgcccaggaggaggaggaggtgggcttccccgtgcgcccccaggtgcccctgcgccccatgacctacaagggcgccttcgacctgtccttcttcctgaaggagaagggcggcctggacggcctgatctactccaagaagcgccaggagatcctggacctgtgggtgtacaacacccagggcttcttccccgactggcagaactacacccccggccccggcatccgctaccccctgtgcttcggctggtgcttcaagctggtgcccgtggacccccgcgaggtggaggaggacaacaagggcgagaacaactgcctgctgcaccccatgtcccagcacggcatcgaggacgaggagcgcgaggtgctgatgtggaagttcgactccgccctggcccgcaagcacatcgcccgcgagctgcaccccgagtactacaaggactgctaa

SEQ ID NO: 198 - protein, 207 aa, Human immunodeficiency virus
MGGKWSKSSIVGWPQVRERIRRAPAPAARGVGPVSQDLDKYGAVTSSNTAANNADCAWLEAQKEEEVGFPVRPQVPLRPMTYKGAFDLSHFLKEKGGLDGLIYSKKRQEILDLWVYHTQGYFPDWQNYTPGPGIRFPLTFGWCYKLVPVDPDEVEEATEGENNSLLHPICQHGMDDEEKEVLMWKFDSRLALTHRARELHPEFYKDC

SEQ ID NO: 199 - DNA, 624 bp, Human immunodeficiency virus
atgggcggcaagtggtccaagtcctccatcgtgggctggccccaggtgcgcgagcgcatccgccgcgcccccgcccccgccgcccgcggcgtgggccccgtgtcccaggacctggacaagtacggcgccgtgacctcctccaacaccgccgccaacaacgccgactgcgcctggctggaggcccagaaggaggaggaggtgggcttccccgtgcgcccccaggtgcccctgcgccccatgacctacaagggcgccttcgacctgtcccacttcctgaaggagaagggcggcctggacggcctgatctactccaagaagcgccaggagatcctggacctgtgggtgtaccacacccagggctacttccccgactggcagaactacacccccggccccggcatccgcttccccctgaccttcggctggtgctacaagctggtgcccgtggaccccgacgaggtggaggaggccaccgagggcgagaacaactccctgctgcaccccatctgccagcacggcatggacgacgaggagaaggaggtgctgatgtggaagttcgactcccgcctggccctgacccaccgcgcccgcgagctgcaccccgagttctacaaggactgctaa

SEQ ID NO: 200 - protein, 212 aa, Human immunodeficiency virus
MGGKWSKSSIVGWPAIRERMRQRGPAQAEPAAAGVGAVSQDLDKHGAITSSNTAATNPDKAWLEAQEEEEEVGFPVRPQVPLRPMTFKAALDLSHFLKEKGGLDGLIYSKKRQEILDLWVYNTQGYFPDWQNYTPGPGERFPLCFGWCFKLVPVDPQEVEEATEGENNCLLHPISQHGMEDEEREVLKWKFDSRLAYKHIARELHPEFYKDC

SEQ ID NO: 201 - DNA, 639 bp, Human immunodeficiency virus
atgggcggcaagtggtccaagtcctccatcgtgggctggcccgccatccgcgagcgcatgcgccagcgcggccccgcccaggccgagcccgccgccgccggcgtgggcgccgtgtcccaggacctggacaagcacggcgccatcacctcctccaacaccgccgccaccaaccccgacaaggcctggctggaggcccaggaggaggaggaggaggtgggcttccccgtgcgcccccaggtgcccctgcgccccatgaccttcaaggccgccctggacctgtcccacttcctgaaggagaagggcggcctggacggcctgatctactccaagaagcgccaggagatcctggacctgtgggtgtacaacacccagggctacttccccgactggcagaactacacccccggccccggcgagcgcttccccctgtgcttcggctggtgcttcaagctggtgcccgtggacccccaggaggtggaggaggccaccgagggcgagaacaactgcctgctgcaccccatctcccagcacggcatggaggacgaggagcgcgaggtgctgaagtggaagttcgactcccgcctggcctacaagcacatcgcccgcgagctgcaccccgagttctacaaggactgctaa

SEQ ID NO: 202 - protein, 208 aa, Human immunodeficiency virus
MGGKWSKSSIVGWPQVRERMRNPPTEGAAEGVGAVSQDLDKHGAITSSNTATTNAACAWLEAQTEDEVGFPVRPQVPLRPMTYKGAFDLSFFLKEKGGLDGLIYSKKRQEILDLWVYHTQGFFPDWQNYTPGPGIRYPLTFGWCYKLVPVDPKEVEEDTKGENNCLLHPMCQHGVEDEEREVLMWKFDSSLARRHIAREMHPEFYKDC

SEQ ID NO: 203 - DNA, 627 bp, Human immunodeficiency virus
atgggcggcaagtggtccaagtcctccatcgtgggctggccccaggtgcgcgagcgcatgcgcaacccccccaccgagggcgccgccgagggcgtgggcgccgtgtcccaggacctggacaagcacggcgccatcacctcctccaacaccgccaccaccaacgccgcctgcgcctggctggaggcccagaccgaggacgaggtgggcttccccgtgcgcccccaggtgcccctgcgccccatgacctacaagggcgccttcgacctgtccttcttcctgaaggagaagggcggcctggacggcctgatctactccaagaagcgccaggagatcctggacctgtgggtgtaccacacccagggcttcttccccgactggcagaactacacccccggccccggcatccgctaccccctgaccttcggctggtgctacaagctggtgcccgtggaccccaaggaggtggaggaggacaccaagggcgagaacaactgcctgctgcaccccatgtgccagcacggcgtggaggacgaggagcgcgaggtgctgatgtggaagttcgactcctccctggcccgccgccacatcgcccgcgagatgcaccccgagttctacaaggactgctaa

SEQ ID NO: 204 - protein, 206 aa, Human immunodeficiency virus
MGGKWSKSSIVGWPAIRERIRRTEPAADGVGAVSRDLEKHGAITSSNTADTNADCAWLETQEEEEVGFPVRPQVPLRPMTFKGALDLSFFLKEKGGLEGLIYSKKRQEILDLWVYHTQGYFPDWHNYTPGPGVRFPLTFGWCFKLVPVDPREVEEANEGEDNCLLHPVCQHGMEDEHREVLKWKFDSQLAHRHRARELHPEFYKDC

SEQ ID NO: 205 - DNA, 621 bp, Human immunodeficiency virus
atgggcggcaagtggtccaagtcctccatcgtgggctggcccgccatccgcgagcgcatccgccgcaccgagcccgccgccgacggcgtgggcgccgtgtcccgcgacctggagaagcacggcgccatcacctcctccaacaccgccgacaccaacgccgactgcgcctggctggagacccaggaggaggaggaggtgggcttccccgtgcgcccccaggtgcccctgcgccccatgaccttcaagggcgccctggacctgtccttcttcctgaaggagaagggcggcctggagggcctgatctactccaagaagcgccaggagatcctggacctgtgggtgtaccacacccagggctacttccccgactggcacaactacacccccggccccggcgtgcgcttccccctgaccttcggctggtgcttcaagctggtgcccgtggacccccgcgaggtggaggaggccaacgagggcgaggacaactgcctgctgcaccccgtgtgccagcacggcatggaggacgagcaccgcgaggtgctgaagtggaagttcgactcccagctggcccaccgccaccgcgcccgcgagctgcaccccgagttctacaaggactgctaa

SEQ ID NO: 206 - protein, 207 aa, Human immunodeficiency virus
MGGKWSKSSIVGWPAVRERIRRTDPAAEGVGAASRDLEKYGAITSSNTAQTNPDCAWLEAQEEEEEVGFPVRPQVPLRPMTYKGAFDLSFFLKEKGGLEGLIYSKRRQDILDLWVYNTQGFFPDWQNYTPGPGIRYPLTFGWCYKLVPVDPREVEEANEGENNSLLHPMSLHGMEDPHGEVLMWKFDSNLAHKHMARELHPEYYKDC

SEQ ID NO: 207 - DNA, 624 bp, Human immunodeficiency virus
atgggcggcaagtggtccaagtcctccatcgtgggctggcccgccgtgcgcgagcgcatccgccgcaccgaccccgccgccgagggcgtgggcgccgcctcccgcgacctggagaagtacggcgccatcacctcctccaacaccgcccagaccaaccccgactgcgcctggctggaggcccaggaggaggaggaggaggtgggcttccccgtgcgcccccaggtgcccctgcgccccatgacctacaagggcgccttcgacctgtccttcttcctgaaggagaagggcggcctggagggcctgatctactccaagcgccgccaggacatcctggacctgtgggtgtacaacacccagggcttcttccccgactggcagaactacacccccggccccggcatccgctaccccctgaccttcggctggtgctacaagctggtgcccgtggacccccgcgaggtggaggaggccaacgagggcgagaacaactccctgctgcaccccatgtccctgcacggcatggaggacccccacggcgaggtgctgatgtggaagttcgactccaacctggcccacaagcacatggcccgcgagctgcaccccgagtactacaaggactgctaa

SEQ ID NO: 208 - protein, 208 aa, Human immunodeficiency virus
MGGKWSKSSIVGWPEIRERLRRTPPTAAAEGVGAVSKDLEKHGAVTSSNTAQTNAACAWLEAQEEEEVGFPVRPQVPLRPMTYKGAFDLGFFLKEKGGLDGLIYSKKRQEILDLWVYHTQGYFPDWQNYTPGPGIRYPLCFGWCFKLVPVEPREVEEANEGENNCLLHPMSQHGMDDEEREVLMWKFDSSLARRHIARELHPDFYKDC

SEQ ID NO: 209 - DNA, 627 bp, Human immunodeficiency virus
atgggcggcaagtggtccaagtcctccatcgtgggctggcccgagatccgcgagcgcctgcgccgcaccccccccaccgccgccgccgagggcgtgggcgccgtgtccaaggacctggagaagcacggcgccgtgacctcctccaacaccgcccagaccaacgccgcctgcgcctggctggaggcccaggaggaggaggaggtgggcttccccgtgcgcccccaggtgcccctgcgccccatgacctacaagggcgccttcgacctgggcttcttcctgaaggagaagggcggcctggacggcctgatctactccaagaagcgccaggagatcctggacctgtgggtgtaccacacccagggctacttccccgactggcagaactacacccccggccccggcatccgctaccccctgtgcttcggctggtgcttcaagctggtgcccgtggagccccgcgaggtggaggaggccaacgagggcgagaacaactgcctgctgcaccccatgtcccagcacggcatggacgacgaggagcgcgaggtgctgatgtggaagttcgactcctccctggcccgccgccacatcgcccgcgagctgcaccccgacttctacaaggactgctaa

SEQ ID NO: 210 - protein, 206 aa, Human immunodeficiency virus
MGGKWSKSSIVGWPDIRERMRRAPPAAEGVGAVSQDLENRGAITSSNTRANNPDLAWLEAQEEEEVGFPVRPQVPLRPMTYKGALDLSHFLKEKGGLEGLIYSKKRQEILDLWVYHTQGYFPDWQNYTPGPGIRYPLTFGWCFKLVPVDPEEVEKANEGENNCLLHPMSQHGMEDEDREVLMWKFDSRLALRHIAREKHPEFYQDC

SEQ ID NO: 211 - DNA, 621 bp, Human immunodeficiency virus
atgggcggcaagtggtccaagtcctccatcgtgggctggcccgacatccgcgagcgcatgcgccgcgccccccccgccgccgagggcgtgggcgccgtgtcccaggacctggagaaccgcggcgccatcacctcctccaacacccgcgccaacaaccccgacctggcctggctggaggcccaggaggaggaggaggtgggcttccccgtgcgcccccaggtgcccctgcgccccatgacctacaagggcgccctggacctgtcccacttcctgaaggagaagggcggcctggagggcctgatctactccaagaagcgccaggagatcctggacctgtgggtgtaccacacccagggctacttccccgactggcagaactacacccccggccccggcatccgctaccccctgaccttcggctggtgcttcaagctggtgcccgtggaccccgaggaggtggagaaggccaacgagggcgagaacaactgcctgctgcaccccatgtcccagcacggcatggaggacgaggaccgcgaggtgctgatgtggaagttcgactcccgcctggccctgcgccacatcgcccgcgagaagcaccccgagttctaccaggactgctaa

SEQ ID NO: 212 - protein, 207 aa, Human immunodeficiency virus
MGGKWSKCSIVGWPEVRERIRRTPPAAVGVGAVSQDLAKHGAITSSNTAANNPDCAWLEAQEEDSEVGFPVRPQVPLRPMTYKGAFDLSFFLKEKGGLDGLIYSKQRQDILDLWVYNTQGFFPDWQNYTPGPGTRYPLTFGWCFKLEPVDPAEVEEATKGENNSLLHPICQHGMEDADNEVLIWRFDSSLARRHIARELHPDFYKDC

SEQ ID NO: 213 - DNA, 624 bp, Human immunodeficiency virus
atgggcggcaagtggtccaagtgctccatcgtgggctggcccgaggtgcgcgagcgcatccgccgcaccccccccgccgccgtgggcgtgggcgccgtgtcccaggacctggccaagcacggcgccatcacctcctccaacaccgccgccaacaaccccgactgcgcctggctggaggcccaggaggaggactccgaggtgggcttccccgtgcgcccccaggtgcccctgcgccccatgacctacaagggcgccttcgacctgtccttcttcctgaaggagaagggcggcctggacggcctgatctactccaagcagcgccaggacatcctggacctgtgggtgtacaacacccagggcttcttccccgactggcagaactacacccccggccccggcacccgctaccccctgaccttcggctggtgcttcaagctggagcccgtggaccccgccgaggtggaggaggccaccaagggcgagaacaactccctgctgcaccccatctgccagcacggcatggaggacgccgacaacgaggtgctgatctggcgcttcgactcctccctggcccgccgccacatcgcccgcgagctgcaccccgacttctacaaggactgctaa

SEQ ID NO: 214 - protein, 1002 aa, Human immunodeficiency virus
FFRENLAFQQGEAREFSSEQTRANSPTSRELRVRGGDNPLSEAGAERQGTVSLSFPQITLWQRPLVTVKIGGQLKEALLDTGADDTVLEEINLPGKWKPKMIGGIGGFIKVRQYDQILIEICGKKAIGTVLVGPTPVNIIGRNMLTQIGCTLNFPISPIETVPVKLKPGMDGPKVKQWPLTEEKIKALTEICTEMEKEGKISKIGPENPYNTPIFAIKKKDSTKWRKLVDFRELNKRTQDFWEVQLGIPHPAGLKKKKSVTVLDVGDAYFSVPLDEDFRKYTAFTIPSINNETPGIRYQYNVLPQGWKGSPAIFQSSMTKILEPFRTQNPEIVIYQYMDDLYVGSDLEIGQHRTKIEELREHLLRWGFTTPDKKHQKEPPFLWMGYELHPDKWTVQPIQLPEKDSWTVNDIQKLVGKLNWASQIYPGIKVKQLCKLLRGAKALTDIVPLTEEAELELAENREILKEPVHGVYYDPSKDLIAEIQKQGQDQWTYQIYQEPFKNLKTGKYAKMRSAHTNDVKQLTEAVQKIATESIVIWGKTPKFRLPIQKETWETWWTEYWQATWIPEWEFVNTPPLVKLWYQLEKEPIVGAETFYVDGAANRETKLGKAGYVTDRGRQKVVSLTETTNQKTELQAIHLALQDSGSEVNIVTDSQYALGIIQAQPDKSESELVNQIIEQLIKKEKVYLSWVPAHKGIGGNEQVDKLVSTGIRKVLFLDGIDKAQEEHEKYHSNWRAMASDFNLPPIVAKEIVASCDKCQLKGEAMHGQVDCSPGIWQLDCTHLEGKIILVAVHVASGYIEAEVIPAETGQETAYFILKLAGRWPVKVIHTDNGSNFTSAAVKAACWWAGIQQEFGIPYNPQSQGVVESMNKELKKIIGQVRDQAEHLKTAVQMAVFIHNFKRKGGIGGYSAGERIIDIIATDIQTKELQKQITKIQNFRVYYRDSRDPIWKGPAKLLWKGEGAVVIQDNSEIKVVPRRKAKIIRDYGKQMAGDDCVAGRQDED

SEQ ID NO: 215 - DNA, 3009 bp, Human immunodeficiency virus
ttcttccgcgagaacctggccttccagcagggcgaggcccgcgagttctcctccgagcagacccgcgccaactcccccacctcccgcgagctgcgcgtgcgcggcggcgacaaccccctgtccgaggccggcgccgagcgccagggcaccgtgtccctgtccttcccccagatcaccctgtggcagcgccccctggtgaccgtgaagatcggcggccagctgaaggaggccctgctggacaccggcgccgacgacaccgtgctggaggagatcaacctgcccggcaagtggaagcccaagatgatcggcggcatcggcggcttcatcaaggtgcgccagtacgaccagatcctgatcgagatctgcggcaagaaggccatcggcaccgtgctggtgggccccacccccgtgaacatcatcggccgcaacatgctgacccagatcggctgcaccctgaacttccccatctcccccatcgagaccgtgcccgtgaagctgaagcccggcatggacggccccaaggtgaagcagtggcccctgaccgaggagaagatcaaggccctgaccgagatctgcaccgagatggagaaggagggcaagatctccaagatcggccccgagaacccctacaacacccccatcttcgccatcaagaagaaggactccaccaagtggcgcaagctggtggacttccgcgagctgaacaagcgcacccaggacttctgggaggtgcagctgggcatcccccaccccgccggcctgaagaagaagaagtccgtgaccgtgctggacgtgggcgacgcctacttctccgtgcccctggacgaggacttccgcaagtacaccgccttcaccatcccctccatcaacaacgagacccccggcatccgctaccagtacaacgtgctgccccagggctggaagggctcccccgccatcttccagtcctccatgaccaagatcctggagcccttccgcacccagaaccccgagatcgtgatctaccagtacatggacgacctgtacgtgggctccgacctggagatcggccagcaccgcaccaagatcgaggagctgcgcgagcacctgctgcgctggggcttcaccacccccgacaagaagcaccagaaggagccccccttcctgtggatgggctacgagctgcaccccgacaagtggaccgtgcagcccatccagctgcccgagaaggactcctggaccgtgaacgacatccagaagctggtgggcaagctgaactgggcctcccagatctaccccggcatcaaggtgaagcagctgtgcaagctgctgcgcggcgccaaggccctgaccgacatcgtgcccctgaccgaggaggccgagctggagctggccgagaaccgcgagatcctgaaggagcccgtgcacggcgtgtactacgacccctccaaggacctgatcgccgagatccagaagcagggccaggaccagtggacctaccagatctaccaggagcccttcaagaacctgaagaccggcaagtacgccaagatgcgctccgcccacaccaacgacgtgaagcagctgaccgaggccgtgcagaagatcgccaccgagtccatcgtgatctggggcaagacccccaagttccgcctgcccatccagaaggagacctgggagacctggtggaccgagtactggcaggccacctggatccccgagtgggagttcgtgaacaccccccccctggtgaagctgtggtaccagctggagaaggagcccatcgtgggcgccgagaccttctacgtggacggcgccgccaaccgcgagaccaagctgggcaaggccggctacgtgaccgaccgcggccgccagaaggtggtgtccctgaccgagaccaccaaccagaagaccgagctgcaggccatccacctggccctgcaggactccggctccgaggtgaacatcgtgaccgactcccagtacgccctgggcatcatccaggcccagcccgacaagtccgagtccgagctggtgaaccagatcatcgagcagctgatcaagaaggagaaggtgtacctgtcctgggtgcccgcccacaagggcatcggcggcaacgagcaggtggacaagctggtgtccaccggcatccgcaaggtgctgttcctggacggcatcgacaaggcccaggaggagcacgagaagtaccactccaactggcgcgccatggcctccgacttcaacctgccccccatcgtggccaaggagatcgtggcctcctgcgacaagtgccagctgaagggcgaggccatgcacggccaggtggactgctcccccggcatctggcagctggactgcacccacctggagggcaagatcatcctggtggccgtgcacgtggcctccggctacatcgaggccgaggtgatccccgccgagaccggccaggagaccgcctacttcatcctgaagctggccggccgctggcccgtgaaggtgatccacaccgacaacggctccaacttcacctccgccgccgtgaaggccgcctgctggtgggccggcatccagcaggagttcggcatcccctacaacccccagtcccagggcgtggtggagtccatgaacaaggagctgaagaagatcatcggccaggtgcgcgaccaggccgagcacctgaagaccgccgtgcagatggccgtgttcatccacaacttcaagcgcaagggcggcatcggcggctactccgccggcgagcgcatcatcgacatcatcgccaccgacatccagaccaaggagctgcagaagcagatcaccaagatccagaacttccgcgtgtactaccgcgactcccgcgaccccatctggaagggccccgccaagctgctgtggaagggcgagggcgccgtggtgatccaggacaactccgagatcaaggtggtgccccgccgcaaggccaagatcatccgcgactacggcaagcagatggccggcgacgactgcgtggccggccgccaggacgaggactaa

SEQ ID NO: 216 - protein, 1002 aa, Human immunodeficiency virus
FFRENLAFQQGEAREFSSEQTRANSPTSRELRVRGGDNPLSEAGAERQGTVSFSFPQITLWQRPLVTIKIGGQLREALLDTGADDTVLEEINLPGKWKPKMIGGIGGFIKVRQYDQILIEICGKKAIGTVLVGPTPVNIIGRNMLTQIGCTLNFPISPIETVPVKLKPGMDGPKVKQWPLTEEKIKALTEICTEMEKEGKISKIGPENPYNTPVFAIKKKDSTKWRKLVDFRELNKRTQDFWEVQLGIPHPAGLKKKKSVTVLDVGDAYFSVPLDEDFRKYTAFTIPSINNETPGIRYQYNVLPQGWKGSPAIFQSSMTKILEPFRTKNPEIVIYQYMDDLYVGSDLEIGQHRAKIEELREHLLRWGFTTPDKKHQKEPPFLWMGYELHPDKWTVQPIQLPEKDSWTVNDIQKLVGKLNWASQIYPGIKVKQLCKLLRGAKALTDIVPLTEEAELELAENREILKEPVHGVYYDPSKDLIAEIQKQGQDQWTYQIYQEPFKNLKTGKYAKMRSAHTNDVKQLTEAVQKIATESIVIWGKTPKFRLPIQKETWETWWTEYWQATWIPEWEFVNTPPLVKLWYQLEKEPIVGAETFYVDGAANRETKLGKAGYVTDRGRQKVVSLTETTNQKTELQAIHLALQDSGSEVNIVTDSQYALGIIQAQPDKSESELVNQIIEQLIKKEKVYLSWVPAHKGIGGNEQVDKLVSSGIRKVLFLDGIDKAQEEHEKYHSNWRAMASDFNLPPVVAKEIVASCDKCQLKGEAMHGQVDCSPGIWQLDCTHLEGKVILVAVHVASGYIEAEVIPAETGQETAYFILKLAGRWPVKVIHTDNGSNFTSAAVKAACWWAGIQQEFGIPYNPQSQGVVESMNKELKKIIGQVRDQAEHLKTAVQMAVFIHNFKRKGGIGGYSAGERIIDIIATDIQTKELQKQITKIQNFRVYYRDSRDPIWKGPAKLLWKGEGAVVIQDNSEIKVVPRRKAKIIRDYGKQMAGDDCVAGRQDED

SEQ ID NO: 217 - protein, 1003 aa, Human immunodeficiency virus
FFRENLAFQQGEARKFSSEQTGANSPTSRDLWDGGRDSLPSEAGAERQGTGPTFSFPQITLWQRPLVTVRIGGQLKEALLDTGADDTVLEDINLPGKWKPKMIGGIGGFIKVKQYDQILIEICGKKAIGTVLVGPTPVNIIGRNMLTQIGCTLNFPISPIETVPVKLKPGMDGPKVKQWPLTEEKIKALTEICTEMEKEGKISKIGPENPYNTPIFAIKKKDSTKWRKLVDFRELNKRTQDFWEVQLGIPHPAGLKKKKSVTVLDVGDAYFSVPLDESFRKYTAFTIPSTNNETPGIRYQYNVLPQGWKGSPAIFQSSMTKILEPFRSKNPEIIIYQYMDDLYVGSDLEIGQHRTKIEELRAHLLSWGFTTPDKKHQKEPPFLWMGYELHPDKWTVQPIELPEKESWTVNDIQKLVGKLNWASQIYAGIKVKQLCKLLRGAKALTDIVTLTEEAELELAENREILKDPVHGVYYDPSKDLIAEIQKQGQDQWTYQIYQEPFKNLKTGKYARKRSAHTNDVKQLAEVVQKVVMESIVIWGKTPKFKLPIQKETWETWWMDYWQATWIPEWEFVNTPPLVKLWYQLEKDPIVGAETFYVDGAANRETKLGKAGYVTDRGRQKVVSLTETTNQKTELHAIHLALQDSGSEVNIVTDSQYALGIIQAQPDRSESELVNQIIEKLIGKDKVYLSWVPAHKGIGGNEQVDKLVSSGIRKVLFLDGIDKAQEEHERYHSNWRAMASDFNLPPIVAKEIVASCDKCQLKGEAMHGQVDCSPGIWQLDCTHLEGKVILVAVHVASGYIEAEVIPAETGQETAYFLLKLAGRWPVKVVHTDNGSNFTSAAVKAACWWANIQQEFGIPYNPQSQGVVESMNKELKKIIGQVREQAEHLKTAVQMAVFIHNFKRKGGIGGYSAGERIIDIIATDIQTKELQKQITKIQNFRVYYRDSRDPIWKGPAKLLWKGEGAVVIQDNSDIKVVPRRKAKIIRDYGKQMAGDDCVAGRQDED

SEQ ID NO: 218 - DNA, 3009 bp, Human immunodeficiency virus
ttcttccgcgagaacctggccttccagcagggcgaggcccgcgagttctcctccgagcagacccgcgccaactcccccacctcccgcgagctgcgcgtgcgcggcggcgacaaccccctgtccgaggccggcgccgagcgccagggcaccgtgtccttctccttcccccagatcaccctgtggcagcgccccctggtgaccatcaagatcggcggccagctgcgcgaggccctgctggacaccggcgccgacgacaccgtgctggaggagatcaacctgcccggcaagtggaagcccaagatgatcggcggcatcggcggcttcatcaaggtgcgccagtacgaccagatcctgatcgagatctgcggcaagaaggccatcggcaccgtgctggtgggccccacccccgtgaacatcatcggccgcaacatgctgacccagatcggctgcaccctgaacttccccatctcccccatcgagaccgtgcccgtgaagctgaagcccggcatggacggccccaaggtgaagcagtggcccctgaccgaggagaagatcaaggccctgaccgagatctgcaccgagatggagaaggagggcaagatctccaagatcggccccgagaacccctacaacacccccgtgttcgccatcaagaagaaggactccaccaagtggcgcaagctggtggacttccgcgagctgaacaagcgcacccaggacttctgggaggtgcagctgggcatcccccaccccgccggcctgaagaagaagaagtccgtgaccgtgctggacgtgggcgacgcctacttctccgtgcccctggacgaggacttccgcaagtacaccgccttcaccatcccctccatcaacaacgagacccccggcatccgctaccagtacaacgtgctgccccagggctggaagggctcccccgccatcttccagtcctccatgaccaagatcctggagcccttccgcaccaagaaccccgagatcgtgatctaccagtacatggacgacctgtacgtgggctccgacctggagatcggccagcaccgcgccaagatcgaggagctgcgcgagcacctgctgcgctggggcttcaccacccccgacaagaagcaccagaaggagccccccttcctgtggatgggctacgagctgcaccccgacaagtggaccgtgcagcccatccagctgcccgagaaggactcctggaccgtgaacgacatccagaagctggtgggcaagctgaactgggcctcccagatctaccccggcatcaaggtgaagcagctgtgcaagctgctgcgcggcgccaaggccctgaccgacatcgtgcccctgaccgaggaggccgagctggagctggccgagaaccgcgagatcctgaaggagcccgtgcacggcgtgtactacgacccctccaaggacctgatcgccgagatccagaagcagggccaggaccagtggacctaccagatctaccaggagcccttcaagaacctgaagaccggcaagtacgccaagatgcgctccgcccacaccaacgacgtgaagcagctgaccgaggccgtgcagaagatcgccaccgagtccatcgtgatctggggcaagacccccaagttccgcctgcccatccagaaggagacctgggagacctggtggaccgagtactggcaggccacctggatccccgagtgggagttcgtgaacaccccccccctggtgaagctgtggtaccagctggagaaggagcccatcgtgggcgccgagaccttctacgtggacggcgccgccaaccgcgagaccaagctgggcaaggccggctacgtgaccgaccgcggccgccagaaggtggtgtccctgaccgagaccaccaaccagaagaccgagctgcaggccatccacctggccctgcaggactccggctccgaggtgaacatcgtgaccgactcccagtacgccctgggcatcatccaggcccagcccgacaagtccgagtccgagctggtgaaccagatcatcgagcagctgatcaagaaggagaaggtgtacctgtcctgggtgcccgcccacaagggcatcggcggcaacgagcaggtggacaagctggtgtcctccggcatccgcaaggtgctgttcctggacggcatcgacaaggcccaggaggagcacgagaagtaccactccaactggcgcgccatggcctccgacttcaacctgccccccgtggtggccaaggagatcgtggcctcctgcgacaagtgccagctgaagggcgaggccatgcacggccaggtggactgctcccccggcatctggcagctggactgcacccacctggagggcaaggtgatcctggtggccgtgcacgtggcctccggctacatcgaggccgaggtgatccccgccgagaccggccaggagaccgcctacttcatcctgaagctggccggccgctggcccgtgaaggtgatccacaccgacaacggctccaacttcacctccgccgccgtgaaggccgcctgctggtgggccggcatccagcaggagttcggcatcccctacaacccccagtcccagggcgtggtggagtccatgaacaaggagctgaagaagatcatcggccaggtgcgcgaccaggccgagcacctgaagaccgccgtgcagatggccgtgttcatccacaacttcaagcgcaagggcggcatcggcggctactccgccggcgagcgcatcatcgacatcatcgccaccgacatccagaccaaggagctgcagaagcagatcaccaagatccagaacttccgcgtgtactaccgcgactcccgcgaccccatctggaagggccccgccaagctgctgtggaagggcgagggcgccgtggtgatccaggacaactccgagatcaaggtggtgccccgccgcaaggccaagatcatccgcgactacggcaagcagatggccggcgacgactgcgtggccggccgccaggacgaggactaa

SEQ ID NO: 219 - DNA, 3012 bp, Human immunodeficiency virus
ttcttccgcgagaacctggccttccagcagggcgaggcccgcaagttctcctccgagcagaccggcgccaactcccccacctcccgcgacctgtgggacggcggccgcgactccctgccctccgaggccggcgccgagcgccagggcaccggccccaccttctccttcccccagatcaccctgtggcagcgccccctggtgaccgtgcgcatcggcggccagctgaaggaggccctgctggacaccggcgccgacgacaccgtgctggaggacatcaacctgcccggcaagtggaagcccaagatgatcggcggcatcggcggcttcatcaaggtgaagcagtacgaccagatcctgatcgagatctgcggcaagaaggccatcggcaccgtgctggtgggccccacccccgtgaacatcatcggccgcaacatgctgacccagatcggctgcaccctgaacttccccatctcccccatcgagaccgtgcccgtgaagctgaagcccggcatggacggccccaaggtgaagcagtggcccctgaccgaggagaagatcaaggccctgaccgagatctgcaccgagatggagaaggagggcaagatctccaagatcggccccgagaacccctacaacacccccatcttcgccatcaagaagaaggactccaccaagtggcgcaagctggtggacttccgcgagctgaacaagcgcacccaggacttctgggaggtgcagctgggcatcccccaccccgccggcctgaagaagaagaagtccgtgaccgtgctggacgtgggcgacgcctacttctccgtgcccctggacgagtccttccgcaagtacaccgccttcaccatcccctccaccaacaacgagacccccggcatccgctaccagtacaacgtgctgccccagggctggaagggctcccccgccatcttccagtcctccatgaccaagatcctggagcccttccgctccaagaaccccgagatcatcatctaccagtacatggacgacctgtacgtgggctccgacctggagatcggccagcaccgcaccaagatcgaggagctgcgcgcccacctgctgtcctggggcttcaccacccccgacaagaagcaccagaaggagccccccttcctgtggatgggctacgagctgcaccccgacaagtggaccgtgcagcccatcgagctgcccgagaaggagtcctggaccgtgaacgacatccagaagctggtgggcaagctgaactgggcctcccagatctacgccggcatcaaggtgaagcagctgtgcaagctgctgcgcggcgccaaggccctgaccgacatcgtgaccctgaccgaggaggccgagctggagctggccgagaaccgcgagatcctgaaggaccccgtgcacggcgtgtactacgacccctccaaggacctgatcgccgagatccagaagcagggccaggaccagtggacctaccagatctaccaggagcccttcaagaacctgaagaccggcaagtacgcccgcaagcgctccgcccacaccaacgacgtgaagcagctggccgaggtggtgcagaaggtggtgatggagtccatcgtgatctggggcaagacccccaagttcaagctgcccatccagaaggagacctgggagacctggtggatggactactggcaggccacctggatccccgagtgggagttcgtgaacaccccccccctggtgaagctgtggtaccagctggagaaggaccccatcgtgggcgccgagaccttctacgtggacggcgccgccaaccgcgagaccaagctgggcaaggccggctacgtgaccgaccgcggccgccagaaggtggtgtccctgaccgagaccaccaaccagaagaccgagctgcacgccatccacctggccctgcaggactccggctccgaggtgaacatcgtgaccgactcccagtacgccctgggcatcatccaggcccagcccgaccgctccgagtccgagctggtgaaccagatcatcgagaagctgatcggcaaggacaaggtgtacctgtcctgggtgcccgcccacaagggcatcggcggcaacgagcaggtggacaagctggtgtcctccggcatccgcaaggtgctgttcctggacggcatcgacaaggcccaggaggagcacgagcgctaccactccaactggcgcgccatggcctccgacttcaacctgccccccatcgtggccaaggagatcgtggcctcctgcgacaagtgccagctgaagggcgaggccatgcacggccaggtggactgctcccccggcatctggcagctggactgcacccacctggagggcaaggtgatcctggtggccgtgcacgtggcctccggctacatcgaggccgaggtgatccccgccgagaccggccaggagaccgcctacttcctgctgaagctggccggccgctggcccgtgaaggtggtgcacaccgacaacggctccaacttcacctccgccgccgtgaaggccgcctgctggtgggccaacatccagcaggagttcggcatcccctacaacccccagtcccagggcgtggtggagtccatgaacaaggagctgaagaagatcatcggccaggtgcgcgagcaggccgagcacctgaagaccgccgtgcagatggccgtgttcatccacaacttcaagcgcaagggcggcatcggcggctactccgccggcgagcgcatcatcgacatcatcgccaccgacatccagaccaaggagctgcagaagcagatcaccaagatccagaacttccgcgtgtactaccgcgactcccgcgaccccatctggaagggccccgccaagctgctgtggaagggcgagggcgccgtggtgatccaggacaactccgacatcaaggtggtgccccgccgcaaggccaagatcatccgcgactacggcaagcagatggccggcgacgactgcgtggccggccgccaggacgaggactaa

SEQ ID NO: 220 - protein, 1003 aa, Human immunodeficiency virus
FFRENLAFQQGEARKFSSEQTRANSPTSRELWDGGRDSLLSEAGAERQGTVPSFSFPQITLWQRPLVTVKIGGQLKEALLDTGADDTVLEDINLPGKWKPKMIGGIGGFIKVRQYDQILIEICGKKAIGTVLVGPTPVNIIGRNMLTQIGCTLNFPISPIETVPVKLKPGMDGPKVKQWPLTEEKIKALTEICTEMEKEGKISKIGPENPYNTPVFAIKKKDSTKWRKLVDFRELNKRTQDFWEVQLGIPHPAGLKKKKSVTVLDVGDAYFSVPLDESFRKYTAFTIPSINNETPGIRYQYNVLPQGWKGSPAIFQSSMTKILEPFRSKNPEIVIYQYMDDLYVGSDLEIGQHRAKIEELRAHLLSWGFTTPDKKHQKEPPFLWMGYELHPDKWTVQPIKLPEKDSWTVNDIQKLVGKLNWASQIYAGIKVKQLCKLLRGAKALTDIVTLTEEAELELAENREILKDPVHGVYYDPSKDLVAEIQKQGQDQWTYQIYQEPFKNLKTGKYAKKRSAHTNDVKQLTEVVQKVATESIVIWGKTPKFRLPIQKETWETWWMEYWQATWIPEWEFVNTPPLVKLWYQLEKEPIAGAETFYVDGAANRETKLGKAGYVTDRGRQKVVSLTETTNQKTELHAIHLALQDSGSEVNIVTDSQYALGIIQAQPDRSESELVNQIIEKLIEKEKVYLSWVPAHKGIGGNEQVDKLVSSGIRKVLFLDGIDKAQEEHEKYHSNWRAMASDFNLPPIVAKEIVASCDKCQLKGEAMHGQVDCSPGIWQLDCTHLEGKVILVAVHVASGYIEAEVIPAETGQETAYFLLKLAGRWPVKVVHTDNGSNFTSAAVKAACWWANIQQEFGIPYNPQSQGVVESMNKELKKIIGQVREQAEHLKTAVQMAVFIHNFKRKGGIGGYSAGERIIDIIATDIQTKELQKQITKIQNFRVYYRDSRDPIWKGPAKLLWKGEGAVVIQDNSDIKVVPRRKAKIIRDYGKQMAGDDCVAGRQDED

SEQ ID NO: 221 - DNA, 3012 bp, Human immunodeficiency virus
ttcttccgcgagaacctggccttccagcagggcgaggcccgcaagttctcctccgagcagacccgcgccaactcccccacctcccgcgagctgtgggacggcggccgcgactccctgctgtccgaggccggcgccgagcgccagggcaccgtgccctccttctccttcccccagatcaccctgtggcagcgccccctggtgaccgtgaagatcggcggccagctgaaggaggccctgctggacaccggcgccgacgacaccgtgctggaggacatcaacctgcccggcaagtggaagcccaagatgatcggcggcatcggcggcttcatcaaggtgcgccagtacgaccagatcctgatcgagatctgcggcaagaaggccatcggcaccgtgctggtgggccccacccccgtgaacatcatcggccgcaacatgctgacccagatcggctgcaccctgaacttccccatctcccccatcgagaccgtgcccgtgaagctgaagcccggcatggacggccccaaggtgaagcagtggcccctgaccgaggagaagatcaaggccctgaccgagatctgcaccgagatggagaaggagggcaagatctccaagatcggccccgagaacccctacaacacccccgtgttcgccatcaagaagaaggactccaccaagtggcgcaagctggtggacttccgcgagctgaacaagcgcacccaggacttctgggaggtgcagctgggcatcccccaccccgccggcctgaagaagaagaagtccgtgaccgtgctggacgtgggcgacgcctacttctccgtgcccctggacgagtccttccgcaagtacaccgccttcaccatcccctccatcaacaacgagacccccggcatccgctaccagtacaacgtgctgccccagggctggaagggctcccccgccatcttccagtcctccatgaccaagatcctggagcccttccgctccaagaaccccgagatcgtgatctaccagtacatggacgacctgtacgtgggctccgacctggagatcggccagcaccgcgccaagatcgaggagctgcgcgcccacctgctgtcctggggcttcaccacccccgacaagaagcaccagaaggagccccccttcctgtggatgggctacgagctgcaccccgacaagtggaccgtgcagcccatcaagctgcccgagaaggactcctggaccgtgaacgacatccagaagctggtgggcaagctgaactgggcctcccagatctacgccggcatcaaggtgaagcagctgtgcaagctgctgcgcggcgccaaggccctgaccgacatcgtgaccctgaccgaggaggccgagctggagctggccgagaaccgcgagatcctgaaggaccccgtgcacggcgtgtactacgacccctccaaggacctggtggccgagatccagaagcagggccaggaccagtggacctaccagatctaccaggagcccttcaagaacctgaagaccggcaagtacgccaagaagcgctccgcccacaccaacgacgtgaagcagctgaccgaggtggtgcagaaggtggccaccgagtccatcgtgatctggggcaagacccccaagttccgcctgcccatccagaaggagacctgggagacctggtggatggagtactggcaggccacctggatccccgagtgggagttcgtgaacaccccccccctggtgaagctgtggtaccagctggagaaggagcccatcgccggcgccgagaccttctacgtggacggcgccgccaaccgcgagaccaagctgggcaaggccggctacgtgaccgaccgcggccgccagaaggtggtgtccctgaccgagaccaccaaccagaagaccgagctgcacgccatccacctggccctgcaggactccggctccgaggtgaacatcgtgaccgactcccagtacgccctgggcatcatccaggcccagcccgaccgctccgagtccgagctggtgaaccagatcatcgagaagctgatcgagaaggagaaggtgtacctgtcctgggtgcccgcccacaagggcatcggcggcaacgagcaggtggacaagctggtgtcctccggcatccgcaaggtgctgttcctggacggcatcgacaaggcccaggaggagcacgagaagtaccactccaactggcgcgccatggcctccgacttcaacctgccccccatcgtggccaaggagatcgtggcctcctgcgacaagtgccagctgaagggcgaggccatgcacggccaggtggactgctcccccggcatctggcagctggactgcacccacctggagggcaaggtgatcctggtggccgtgcacgtggcctccggctacatcgaggccgaggtgatccccgccgagaccggccaggagaccgcctacttcctgctgaagctggccggccgctggcccgtgaaggtggtgcacaccgacaacggctccaacttcacctccgccgccgtgaaggccgcctgctggtgggccaacatccagcaggagttcggcatcccctacaacccccagtcccagggcgtggtggagtccatgaacaaggagctgaagaagatcatcggccaggtgcgcgagcaggccgagcacctgaagaccgccgtgcagatggccgtgttcatccacaacttcaagcgcaagggcggcatcggcggctactccgccggcgagcgcatcatcgacatcatcgccaccgacatccagaccaaggagctgcagaagcagatcaccaagatccagaacttccgcgtgtactaccgcgactcccgcgaccccatctggaagggccccgccaagctgctgtggaagggcgagggcgccgtggtgatccaggacaactccgacatcaaggtggtgccccgccgcaaggccaagatcatccgcgactacggcaagcagatggccggcgacgactgcgtggccggccgccaggacgaggactaa

SEQ ID NO: 222 - protein, 1003 aa, Human immunodeficiency virus
FFRENLAFQQREARKFSSEQNRANSPTSRELRNGGRDNLLSEAGAEEQGTVHSCNFPQITLWQRPLVTVKIEGQLREALLDTGADDTVLEDINLPGKWKPKMIGGIGGFIKVRQYDQIAIEICGKRAIGTVLVGPTPVNIIGRNMLVQLGCTLNFPISPIETVPVKLKPGMDGPKVKQWPLTEEKIKALTEICKEMEKEGKISKIGPENPYNTPVFAIKKKDSTKWRKLVDFRELNKRTQDFWEVQLGIPHPAGLKKKKSVTVLDVGDAYFSVPLHEDFRKYTAFTIPSINNETPGIRYQYNVLPQGWKGSPAIFQSSMTKILEPFRSKNPEMVIYQYMDDLYVGSDLEIGQHRAKIEELRAHLLRWGFTTPDKKHQKEPPFLWMGYELHPDKWTVQPIKLPEKDSWTVNDIQKLVGKLNWASQIYAGIKVKQLCKLLRGTKALTDIVTLTKEAELELEENREILKNPVHGVYYDPSKDLIAEIQKQGQDQWTYQIYQEPFKNLKTGKYAKRKSTHTNDVKQLTEAVQKIAIESIVIWGKTPKFRLPIQKETWETWWTEYWQATWIPEWEFVNTPPLVKLWYQLETEPIAGAETFYVDGAANRETKLGKAGYVTDRGRQKIVSLTETTNQKTELHAIYLALQDSGLEVNIVTDSQYALGIIQAQPDRSESELVNQIIEKLIEKERVYLSWVPAHKGIGGNEQVDKLVSSGIRKVLFLDGIDKAQEEHERYHSNWRAMAHDFNLPPIVAKEIVASCDKCQLKGEAMHGQVDCSPGIWQLDCTHLEGKVILVAVHVASGYIEAEVIPAETGQETAYFILKLAGRWPVKVIHTDNGPNFTSATVKAACWWAGVQQEFGIPYNPQSQGVVESMNKELKKIIGQVRDQAEHLKTAVQMAVFIHNFKRKGGIGGYSAGERIIDIIATDIQTKELQKQIIKIQNFRVYYRDSRDPIWKGPAKLLWKGEGAVVIQDNSDIKVVPRRKAKIIRDYGKQMAGDDCVAGRQDED

SEQ ID NO: 223 - protein, 1003 aa, Human immunodeficiency virus
FFREDLAFPQGKAREFSSEQTRANSPTRRELQVWGRDNNSLSEAGADRQGTVSFSFPQITLWQRPLVTIKIGGQLKEALLDTGADDTVLEEMNLPGRWKPKMIGGIGGFIKVRQYDQILIEICGHKAIGTVLVGPTPVNIIGRNLLTQIGCTLNFPISPIETVPVKLKPGMDGPKVKQWPLTEEKIKALVEICTEMEKEGKISKIGPENPYNTPVFAIKKKDSTKWRKLVDFRELNKRTQDFWEVQLGIPHPAGLKKKKSVTVLDVGDAYFSVPLDKDFRKYTAFTIPSINNETPGIRYQYNVLPQGWKGSPAIFQSSMTKILEPFRKQNPDIVIYQYMDDLYVGSDLEIGQHRTKIEELRQHLLRWGFTTPDKKHQKEPPFLWMGYELHPDKWTVQPIVLPEKDSWTVNDIQKLVGKLNWASQIYAGIKVKQLCKLLRGTKALTEVIPLTEEAELELAENREILKEPVHGVYYDPSKDLIAEIQKQGQGQWTYQIYQEPFKNLKTGKYARMRGAHTNDVKQLTEAVQKIATESIVIWGKTPKFKLPIQKETWEAWWTEYWQATWIPEWEFVNTPPLVKLWYQLEKEPIVGAETFYVDGAANRETKLGKAGYVTDRGRQKVVSLTDTTNQKTELQAIHLALQDSGLEVNIVTDSQYALGIIQAQPDKSESELVSQIIEQLIKKEKVYLAWVPAHKGIGGNEQVDKLVSAGIRKVLFLDGIDKAQEEHEKYHSNWRAMASDFNLPPVVAKEIVASCDKCQLKGEAMHGQVDCSPGIWQLDCTHLEGKIILVAVHVASGYIEAEVIPAETGQETAYFLLKLAGRWPVKTIHTDNGSNFTSTTVKAACWWAGIKQEFGIPYNPQSQGVVESMNKELKKIIGQVRDQAEHLKTAVQMAVFIHNFKRKGGIGGYSAGERIVDIIATDIQTKELQKQITKIQNFRVYYRDSRDPLWKGPAKLLWKGEGAVVIQDNSDIKVVPRRKAKIIRDYGKQMAGDDCVASRQDED

SEQ ID NO: 224 - DNA, 3012 bp, Human immunodeficiency virus
ttcttccgcgagaacctggccttccagcagcgcgaggcccgcaagttctcctccgagcagaaccgcgccaactcccccacctcccgcgagctgcgcaacggcggccgcgacaacctgctgtccgaggccggcgccgaggagcagggcaccgtgcactcctgcaacttcccccagatcaccctgtggcagcgccccctggtgaccgtgaagatcgagggccagctgcgcgaggccctgctggacaccggcgccgacgacaccgtgctggaggacatcaacctgcccggcaagtggaagcccaagatgatcggcggcatcggcggcttcatcaaggtgcgccagtacgaccagatcgccatcgagatctgcggcaagcgcgccatcggcaccgtgctggtgggccccacccccgtgaacatcatcggccgcaacatgctggtgcagctgggctgcaccctgaacttccccatctcccccatcgagaccgtgcccgtgaagctgaagcccggcatggacggccccaaggtgaagcagtggcccctgaccgaggagaagatcaaggccctgaccgagatctgcaaggagatggagaaggagggcaagatctccaagatcggccccgagaacccctacaacacccccgtgttcgccatcaagaagaaggactccaccaagtggcgcaagctggtggacttccgcgagctgaacaagcgcacccaggacttctgggaggtgcagctgggcatcccccaccccgccggcctgaagaagaagaagtccgtgaccgtgctggacgtgggcgacgcctacttctccgtgcccctgcacgaggacttccgcaagtacaccgccttcaccatcccctccatcaacaacgagacccccggcatccgctaccagtacaacgtgctgccccagggctggaagggctcccccgccatcttccagtcctccatgaccaagatcctggagcccttccgctccaagaaccccgagatggtgatctaccagtacatggacgacctgtacgtgggctccgacctggagatcggccagcaccgcgccaagatcgaggagctgcgcgcccacctgctgcgctggggcttcaccacccccgacaagaagcaccagaaggagccccccttcctgtggatgggctacgagctgcaccccgacaagtggaccgtgcagcccatcaagctgcccgagaaggactcctggaccgtgaacgacatccagaagctggtgggcaagctgaactgggcctcccagatctacgccggcatcaaggtgaagcagctgtgcaagctgctgcgcggcaccaaggccctgaccgacatcgtgaccctgaccaaggaggccgagctggagctggaggagaaccgcgagatcctgaagaaccccgtgcacggcgtgtactacgacccctccaaggacctgatcgccgagatccagaagcagggccaggaccagtggacctaccagatctaccaggagcccttcaagaacctgaagaccggcaagtacgccaagcgcaagtccacccacaccaacgacgtgaagcagctgaccgaggccgtgcagaagatcgccatcgagtccatcgtgatctggggcaagacccccaagttccgcctgcccatccagaaggagacctgggagacctggtggaccgagtactggcaggccacctggatccccgagtgggagttcgtgaacaccccccccctggtgaagctgtggtaccagctggagaccgagcccatcgccggcgccgagaccttctacgtggacggcgccgccaaccgcgagaccaagctgggcaaggccggctacgtgaccgaccgcggccgccagaagatcgtgtccctgaccgagaccaccaaccagaagaccgagctgcacgccatctacctggccctgcaggactccggcctggaggtgaacatcgtgaccgactcccagtacgccctgggcatcatccaggcccagcccgaccgctccgagtccgagctggtgaaccagatcatcgagaagctgatcgagaaggagcgcgtgtacctgtcctgggtgcccgcccacaagggcatcggcggcaacgagcaggtggacaagctggtgtcctccggcatccgcaaggtgctgttcctggacggcatcgacaaggcccaggaggagcacgagcgctaccactccaactggcgcgccatggcccacgacttcaacctgccccccatcgtggccaaggagatcgtggcctcctgcgacaagtgccagctgaagggcgaggccatgcacggccaggtggactgctcccccggcatctggcagctggactgcacccacctggagggcaaggtgatcctggtggccgtgcacgtggcctccggctacatcgaggccgaggtgatccccgccgagaccggccaggagaccgcctacttcatcctgaagctggccggccgctggcccgtgaaggtgatccacaccgacaacggccccaacttcacctccgccaccgtgaaggccgcctgctggtgggccggcgtgcagcaggagttcggcatcccctacaacccccagtcccagggcgtggtggagtccatgaacaaggagctgaagaagatcatcggccaggtgcgcgaccaggccgagcacctgaagaccgccgtgcagatggccgtgttcatccacaacttcaagcgcaagggcggcatcggcggctactccgccggcgagcgcatcatcgacatcatcgccaccgacatccagaccaaggagctgcagaagcagatcatcaagatccagaacttccgcgtgtactaccgcgactcccgcgaccccatctggaagggccccgccaagctgctgtggaagggcgagggcgccgtggtgatccaggacaactccgacatcaaggtggtgccccgccgcaaggccaagatcatccgcgactacggcaagcagatggccggcgacgactgcgtggccggccgccaggacgaggactaa

SEQ ID NO: 225 - DNA, 3012 bp, Human immunodeficiency virus
ttcttccgcgaggacctggccttcccccagggcaaggcccgcgagttctcctccgagcagacccgcgccaactcccccacccgccgcgagctgcaggtgtggggccgcgacaacaactccctgtccgaggccggcgccgaccgccagggcaccgtgtccttctccttcccccagatcaccctgtggcagcgccccctggtgaccatcaagatcggcggccagctgaaggaggccctgctggacaccggcgccgacgacaccgtgctggaggagatgaacctgcccggccgctggaagcccaagatgatcggcggcatcggcggcttcatcaaggtgcgccagtacgaccagatcctgatcgagatctgcggccacaaggccatcggcaccgtgctggtgggccccacccccgtgaacatcatcggccgcaacctgctgacccagatcggctgcaccctgaacttccccatctcccccatcgagaccgtgcccgtgaagctgaagcccggcatggacggccccaaggtgaagcagtggcccctgaccgaggagaagatcaaggccctggtggagatctgcaccgagatggagaaggagggcaagatctccaagatcggccccgagaacccctacaacacccccgtgttcgccatcaagaagaaggactccaccaagtggcgcaagctggtggacttccgcgagctgaacaagcgcacccaggacttctgggaggtgcagctgggcatcccccaccccgccggcctgaagaagaagaagtccgtgaccgtgctggacgtgggcgacgcctacttctccgtgcccctggacaaggacttccgcaagtacaccgccttcaccatcccctccatcaacaacgagacccccggcatccgctaccagtacaacgtgctgccccagggctggaagggctcccccgccatcttccagtcctccatgaccaagatcctggagcccttccgcaagcagaaccccgacatcgtgatctaccagtacatggacgacctgtacgtgggctccgacctggagatcggccagcaccgcaccaagatcgaggagctgcgccagcacctgctgcgctggggcttcaccacccccgacaagaagcaccagaaggagccccccttcctgtggatgggctacgagctgcaccccgacaagtggaccgtgcagcccatcgtgctgcccgagaaggactcctggaccgtgaacgacatccagaagctggtgggcaagctgaactgggcctcccagatctacgccggcatcaaggtgaagcagctgtgcaagctgctgcgcggcaccaaggccctgaccgaggtgatccccctgaccgaggaggccgagctggagctggccgagaaccgcgagatcctgaaggagcccgtgcacggcgtgtactacgacccctccaaggacctgatcgccgagatccagaagcagggccagggccagtggacctaccagatctaccaggagcccttcaagaacctgaagaccggcaagtacgcccgcatgcgcggcgcccacaccaacgacgtgaagcagctgaccgaggccgtgcagaagatcgccaccgagtccatcgtgatctggggcaagacccccaagttcaagctgcccatccagaaggagacctgggaggcctggtggaccgagtactggcaggccacctggatccccgagtgggagttcgtgaacaccccccccctggtgaagctgtggtaccagctggagaaggagcccatcgtgggcgccgagaccttctacgtggacggcgccgccaaccgcgagaccaagctgggcaaggccggctacgtgaccgaccgcggccgccagaaggtggtgtccctgaccgacaccaccaaccagaagaccgagctgcaggccatccacctggccctgcaggactccggcctggaggtgaacatcgtgaccgactcccagtacgccctgggcatcatccaggcccagcccgacaagtccgagtccgagctggtgtcccagatcatcgagcagctgatcaagaaggagaaggtgtacctggcctgggtgcccgcccacaagggcatcggcggcaacgagcaggtggacaagctggtgtccgccggcatccgcaaggtgctgttcctggacggcatcgacaaggcccaggaggagcacgagaagtaccactccaactggcgcgccatggcctccgacttcaacctgccccccgtggtggccaaggagatcgtggcctcctgcgacaagtgccagctgaagggcgaggccatgcacggccaggtggactgctcccccggcatctggcagctggactgcacccacctggagggcaagatcatcctggtggccgtgcacgtggcctccggctacatcgaggccgaggtgatccccgccgagaccggccaggagaccgcctacttcctgctgaagctggccggccgctggcccgtgaagaccatccacaccgacaacggctccaacttcacctccaccaccgtgaaggccgcctgctggtgggccggcatcaagcaggagttcggcatcccctacaacccccagtcccagggcgtggtggagtccatgaacaaggagctgaagaagatcatcggccaggtgcgcgaccaggccgagcacctgaagaccgccgtgcagatggccgtgttcatccacaacttcaagcgcaagggcggcatcggcggctactccgccggcgagcgcatcgtggacatcatcgccaccgacatccagaccaaggagctgcagaagcagatcaccaagatccagaacttccgcgtgtactaccgcgactcccgcgaccccctgtggaagggccccgccaagctgctgtggaagggcgagggcgccgtggtgatccaggacaactccgacatcaaggtggtgccccgccgcaaggccaagatcatccgcgactacggcaagcagatggccggcgacgactgcgtggcctcccgccaggacgaggactaa

SEQ ID NO: 226 - protein, 1003 aa, Human immunodeficiency virus
FFRENLAFPQGKAREFSSEQTRANSPTRRELQVWGRDNNPLSEAGADRQGTVSFSFPQITLWQRPLVTIKIGGQLKEALLDTGADDTVLEEMNLPGKWKPKMIGGIGGFIKVRQYDQILIEICGHKAIGTVLVGPTPVNIIGRNLLTQIGCTLNFPISPIETVPVKLKPGMDGPKVKQWPLTEEKIKALVEICTEMEKEGKISKIGPENPYNTPVFAIKKKDSTKWRKLVDFRELNKRTQDFWEVQLGIPHPAGLKKKKSVTVLDVGDAYFSVPLDKDFRKYTAFTIPSINNETPGIRYQYNVLPQGWKGSPAIFQSSMTKILEPFRKQNPEIVIYQYMDDLYVGSDLEIGQHRTKIEELREHLLRWGFTTPDKKHQKEPPFLWMGYELHPDKWTVQPIVLPEKDSWTVNDIQKLVGKLNWASQIYAGIKVKQLCKLLRGTKALTEVVPLTEEAELELAENREILKEPVHGVYYDPSKDLIAEIQKQGQGQWTYQIYQEPFKNLKTGKYARMRGAHTNDVKQLTEAVQKIATESIVIWGKTPKFKLPIQKETWEAWWTEYWQATWIPEWEFVNTPPLVKLWYQLEKEPIVGAETFYVDGAANRETKLGKAGYVTDRGRQKVVSLTDTTNQKTELQAIHLALQDSGLEVNIVTDSQYALGIIQAQPDKSESELVSQIIEQLIKKEKVYLAWVPAHKGIGGNEQVDKLVSAGIRKVLFLDGIDKAQEEHEKYHSNWRAMASDFNLPPVVAKEIVASCDKCQLKGEAMHGQVDCSPGIWQLDCTHLEGKIILVAVHVASGYIEAEVIPAETGQETAYFILKLAGRWPVKVIHTDNGSNFTSTTVKAACWWAGIKQEFGIPYNPQSQGVVESMNKELKKIIGQVRDQAEHLKTAVQMAVFIHNFKRKGGIGGYSAGERIVDIIATDIQTKELQKQITKIQNFRVYYRDSRDPLWKGPAKLLWKGEGAVVIQDNSDIKVVPRRKAKIIRDYGKQMAGDDCVASRQDED

SEQ ID NO: 227 - DNA, 3012 bp, Human immunodeficiency virus
ttcttccgcgagaacctggccttcccccagggcaaggcccgcgagttctcctccgagcagacccgcgccaactcccccacccgccgcgagctgcaggtgtggggccgcgacaacaaccccctgtccgaggccggcgccgaccgccagggcaccgtgtccttctccttcccccagatcaccctgtggcagcgccccctggtgaccatcaagatcggcggccagctgaaggaggccctgctggacaccggcgccgacgacaccgtgctggaggagatgaacctgcccggcaagtggaagcccaagatgatcggcggcatcggcggcttcatcaaggtgcgccagtacgaccagatcctgatcgagatctgcggccacaaggccatcggcaccgtgctggtgggccccacccccgtgaacatcatcggccgcaacctgctgacccagatcggctgcaccctgaacttccccatctcccccatcgagaccgtgcccgtgaagctgaagcccggcatggacggccccaaggtgaagcagtggcccctgaccgaggagaagatcaaggccctggtggagatctgcaccgagatggagaaggagggcaagatctccaagatcggccccgagaacccctacaacacccccgtgttcgccatcaagaagaaggactccaccaagtggcgcaagctggtggacttccgcgagctgaacaagcgcacccaggacttctgggaggtgcagctgggcatcccccaccccgccggcctgaagaagaagaagtccgtgaccgtgctggacgtgggcgacgcctacttctccgtgcccctggacaaggacttccgcaagtacaccgccttcaccatcccctccatcaacaacgagacccccggcatccgctaccagtacaacgtgctgccccagggctggaagggctcccccgccatcttccagtcctccatgaccaagatcctggagcccttccgcaagcagaaccccgagatcgtgatctaccagtacatggacgacctgtacgtgggctccgacctggagatcggccagcaccgcaccaagatcgaggagctgcgcgagcacctgctgcgctggggcttcaccacccccgacaagaagcaccagaaggagccccccttcctgtggatgggctacgagctgcaccccgacaagtggaccgtgcagcccatcgtgctgcccgagaaggactcctggaccgtgaacgacatccagaagctggtgggcaagctgaactgggcctcccagatctacgccggcatcaaggtgaagcagctgtgcaagctgctgcgcggcaccaaggccctgaccgaggtggtgcccctgaccgaggaggccgagctggagctggccgagaaccgcgagatcctgaaggagcccgtgcacggcgtgtactacgacccctccaaggacctgatcgccgagatccagaagcagggccagggccagtggacctaccagatctaccaggagcccttcaagaacctgaagaccggcaagtacgcccgcatgcgcggcgcccacaccaacgacgtgaagcagctgaccgaggccgtgcagaagatcgccaccgagtccatcgtgatctggggcaagacccccaagttcaagctgcccatccagaaggagacctgggaggcctggtggaccgagtactggcaggccacctggatccccgagtgggagttcgtgaacaccccccccctggtgaagctgtggtaccagctggagaaggagcccatcgtgggcgccgagaccttctacgtggacggcgccgccaaccgcgagaccaagctgggcaaggccggctacgtgaccgaccgcggccgccagaaggtggtgtccctgaccgacaccaccaaccagaagaccgagctgcaggccatccacctggccctgcaggactccggcctggaggtgaacatcgtgaccgactcccagtacgccctgggcatcatccaggcccagcccgacaagtccgagtccgagctggtgtcccagatcatcgagcagctgatcaagaaggagaaggtgtacctggcctgggtgcccgcccacaagggcatcggcggcaacgagcaggtggacaagctggtgtccgccggcatccgcaaggtgctgttcctggacggcatcgacaaggcccaggaggagcacgagaagtaccactccaactggcgcgccatggcctccgacttcaacctgccccccgtggtggccaaggagatcgtggcctcctgcgacaagtgccagctgaagggcgaggccatgcacggccaggtggactgctcccccggcatctggcagctggactgcacccacctggagggcaagatcatcctggtggccgtgcacgtggcctccggctacatcgaggccgaggtgatccccgccgagaccggccaggagaccgcctacttcatcctgaagctggccggccgctggcccgtgaaggtgatccacaccgacaacggctccaacttcacctccaccaccgtgaaggccgcctgctggtgggccggcatcaagcaggagttcggcatcccctacaacccccagtcccagggcgtggtggagtccatgaacaaggagctgaagaagatcatcggccaggtgcgcgaccaggccgagcacctgaagaccgccgtgcagatggccgtgttcatccacaacttcaagcgcaagggcggcatcggcggctactccgccggcgagcgcatcgtggacatcatcgccaccgacatccagaccaaggagctgcagaagcagatcaccaagatccagaacttccgcgtgtactaccgcgactcccgcgaccccctgtggaagggccccgccaagctgctgtggaagggcgagggcgccgtggtgatccaggacaactccgacatcaaggtggtgccccgccgcaaggccaagatcatccgcgactacggcaagcagatggccggcgacgactgcgtggcctcccgccaggacgaggactaa

SEQ ID NO: 228 - protein, 999 aa, Human immunodeficiency virus
FFRENLAFPQGEAREFPSEQTRANSPTSRELQVRGDNPRSEAGAERQGTLNFPQITLWQRPLVSIKVGGQIKEALLDTGADDTVLEEINLPGKWKPKMIGGIGGFIKVRQYDQILIEICGKKAIGTVLVGPTPVNIIGRNMLTQLGCTLNFPISPIETVPVKLKPGMDGPKVKQWPLTEEKIKALTAICEEMEKEGKITKIGPENPYNTPVFAIKKKDSTKWRKLVDFRELNKRTQDFWEVQLGIPHPAGLKKKKSVTVLDVGDAYFSVPLDEGFRKYTAFTIPSINNETPGIRYQYNVLPQGWKGSPAIFQSSMTKILEPFRAQNPEIVIYQYMDDLYVGSDLEIGQHRAKIEELREHLLKWGFTTPDKKHQKEPPFLWMGYELHPDKWTVQPIQLPEKDSWTVNDIQKLVGKLNWASQIYPGIKVRQLCKLLRGAKALTDIVPLTEEAELELAENREILKEPVHGVYYDPSKDLIAEIQKQGHDQWTYQIYQEPFKNLKTGKYAKMRTAHTNDVKQLTEAVQKIAMESIVIWGKTPKFRLPIQKETWETWWTDYWQATWIPEWEFVNTPPLVKLWYQLEKEPIAGAETFYVDGAANRETKIGKAGYVTDRGRQKIVSLTETTNQKTELQAIQLALQDSGSEVNIVTDSQYALGIIQAQPDKSESELVNQIIEQLIKKERVYLSWVPAHKGIGGNEQVDKLVSSGIRKVLFLDGIDKAQEEHEKYHSNWRAMASEFNLPPIVAKEIVASCDKCQLKGEAIHGQVDCSPGIWQLDCTHLEGKIILVAVHVASGYIEAEVIPAETGQETAYYILKLAGRWPVKVIHTDNGSNFTSAAVKAACWWAGIQQEFGIPYNPQSQGVVESMNKELKKIIGQVRDQAEHLKTAVQMAVFIHNFKRKGGIGGYSAGERIIDIIATDIQTKELQKQIIKIQNFRVYYRDSRDPIWKGPAKLLWKGEGAVVIQDNSDIKVVPRRKAKIIKDYGKQMAGADCVAGRQDED

SEQ ID NO: 229 - DNA, 3000 bp, Human immunodeficiency virus
ttcttccgcgagaacctggccttcccccagggcgaggcccgcgagttcccctccgagcagacccgcgccaactcccccacctcccgcgagctgcaggtgcgcggcgacaacccccgctccgaggccggcgccgagcgccagggcaccctgaacttcccccagatcaccctgtggcagcgccccctggtgtccatcaaggtgggcggccagatcaaggaggccctgctggacaccggcgccgacgacaccgtgctggaggagatcaacctgcccggcaagtggaagcccaagatgatcggcggcatcggcggcttcatcaaggtgcgccagtacgaccagatcctgatcgagatctgcggcaagaaggccatcggcaccgtgctggtgggccccacccccgtgaacatcatcggccgcaacatgctgacccagctgggctgcaccctgaacttccccatctcccccatcgagaccgtgcccgtgaagctgaagcccggcatggacggccccaaggtgaagcagtggcccctgaccgaggagaagatcaaggccctgaccgccatctgcgaggagatggagaaggagggcaagatcaccaagatcggccccgagaacccctacaacacccccgtgttcgccatcaagaagaaggactccaccaagtggcgcaagctggtggacttccgcgagctgaacaagcgcacccaggacttctgggaggtgcagctgggcatcccccaccccgccggcctgaagaagaagaagtccgtgaccgtgctggacgtgggcgacgcctacttctccgtgcccctggacgagggcttccgcaagtacaccgccttcaccatcccctccatcaacaacgagacccccggcatccgctaccagtacaacgtgctgccccagggctggaagggctcccccgccatcttccagtcctccatgaccaagatcctggagcccttccgcgcccagaaccccgagatcgtgatctaccagtacatggacgacctgtacgtgggctccgacctggagatcggccagcaccgcgccaagatcgaggagctgcgcgagcacctgctgaagtggggcttcaccacccccgacaagaagcaccagaaggagccccccttcctgtggatgggctacgagctgcaccccgacaagtggaccgtgcagcccatccagctgcccgagaaggactcctggaccgtgaacgacatccagaagctggtgggcaagctgaactgggcctcccagatctaccccggcatcaaggtgcgccagctgtgcaagctgctgcgcggcgccaaggccctgaccgacatcgtgcccctgaccgaggaggccgagctggagctggccgagaaccgcgagatcctgaaggagcccgtgcacggcgtgtactacgacccctccaaggacctgatcgccgagatccagaagcagggccacgaccagtggacctaccagatctaccaggagcccttcaagaacctgaagaccggcaagtacgccaagatgcgcaccgcccacaccaacgacgtgaagcagctgaccgaggccgtgcagaagatcgccatggagtccatcgtgatctggggcaagacccccaagttccgcctgcccatccagaaggagacctgggagacctggtggaccgactactggcaggccacctggatccccgagtgggagttcgtgaacaccccccccctggtgaagctgtggtaccagctggagaaggagcccatcgccggcgccgagaccttctacgtggacggcgccgccaaccgcgagaccaagatcggcaaggccggctacgtgaccgaccgcggccgccagaagatcgtgtccctgaccgagaccaccaaccagaagaccgagctgcaggccatccagctggccctgcaggactccggctccgaggtgaacatcgtgaccgactcccagtacgccctgggcatcatccaggcccagcccgacaagtccgagtccgagctggtgaaccagatcatcgagcagctgatcaagaaggagcgcgtgtacctgtcctgggtgcccgcccacaagggcatcggcggcaacgagcaggtggacaagctggtgtcctccggcatccgcaaggtgctgttcctggacggcatcgacaaggcccaggaggagcacgagaagtaccactccaactggcgcgccatggcctccgagttcaacctgccccccatcgtggccaaggagatcgtggcctcctgcgacaagtgccagctgaagggcgaggccatccacggccaggtggactgctcccccggcatctggcagctggactgcacccacctggagggcaagatcatcctggtggccgtgcacgtggcctccggctacatcgaggccgaggtgatccccgccgagaccggccaggagaccgcctactacatcctgaagctggccggccgctggcccgtgaaggtgatccacaccgacaacggctccaacttcacctccgccgccgtgaaggccgcctgctggtgggccggcatccagcaggagttcggcatcccctacaacccccagtcccagggcgtggtggagtccatgaacaaggagctgaagaagatcatcggccaggtgcgcgaccaggccgagcacctgaagaccgccgtgcagatggccgtgttcatccacaacttcaagcgcaagggcggcatcggcggctactccgccggcgagcgcatcatcgacatcatcgccaccgacatccagaccaaggagctgcagaagcagatcatcaagatccagaacttccgcgtgtactaccgcgactcccgcgaccccatctggaagggccccgccaagctgctgtggaagggcgagggcgccgtggtgatccaggacaactccgacatcaaggtggtgccccgccgcaaggccaagatcatcaaggactacggcaagcagatggccggcgccgactgcgtggccggccgccaggacgaggactaa

SEQ ID NO: 230 - protein, 1001 aa, Human immunodeficiency virus
FFRENLAFPQGEAREFPSEQTRANSPTSRELQVGRDNPRSEAGAERQGTLTLNFPQITLWQRPLVSIKVGGQIKEALLDTGADDTVLEEINLPGKWKPKMIGGIGGFIKVRQYDQILIEICGKKAIGTVLVGPTPVNIIGRNMLTQLGCTLNFPISPIETVPVKLKPGMDGPKVKQWPLTEEKIKALTAICEEMEKEGKITKIGPENPYNTPVFAIKKKDSTKWRKLVDFRELNKRTQDFWEVQLGIPHPAGLKKKKSVTVLDVGDAYFSVPLDEGFRKYTAFTIPSINNETPGIRYQYNVLPQGWKGSPAIFQSSMTKILEPFRAQNPEIVIYQYMDDLYVGSDLEIGQHRAKIEELREHLLKWGFTTPDKKHQKEPPFLWMGYELHPDKWTVQPIQLPEKDSWTVNDIQKLVGKLNWASQIYPGIKVRQLCKLLRGAKALTDIVPLTEEAELELAENREILKEPVHGVYYDPSKDLIAEIQKQGHDQWTYQIYQEPFKNLKTGKYAKMRTAHTNDVKQLTEAVQKIAMESIVIWGKTPKFRLPIQKETWETWWTDYWQATWIPEWEFVNTPPLVKLWYQLEKEPIAGAETFYVDGAANRETKIGKAGYVTDRGRQKIVSLTETTNQKTELQAIQLALQDSGSEVNIVTDSQYALGIIQAQPDKSESELVNQIIEQLIKKEKVYLSWVPAHKGIGGNEQVDKLVSSGIRKVLFLDGIDKAQEEHEKYHSNWRAMASEFNLPPIVAKEIVASCDKCQLKGEAMHGQVDCSPGIWQLDCTHLEGKIILVAVHVASGYIEAEVIPAETGQETAYFILKLAGRWPVKVIHTDNGSNFTSAAVKAACWWAGIQQEFGIPYNPQSQGVVESMNKELKKIIGQVRDQAEHLKTAVQMAVFIHNFKRKGGIGGYSAGERIIDIIATDIQTKELQKQIIKIQNFRVYYRDSRDPIWKGPAKLLWKGEGAVVIQDNSDIKVVPRRKAKIIRDYGKQMAGADCVAGRQDED

SEQ ID NO: 231 - DNA, 3006 bp, Human immunodeficiency virus
ttcttccgcgagaacctggccttcccccagggcgaggcccgcgagttcccctccgagcagacccgcgccaactcccccacctcccgcgagctgcaggtgggccgcgacaacccccgctccgaggccggcgccgagcgccagggcaccctgaccctgaacttcccccagatcaccctgtggcagcgccccctggtgtccatcaaggtgggcggccagatcaaggaggccctgctggacaccggcgccgacgacaccgtgctggaggagatcaacctgcccggcaagtggaagcccaagatgatcggcggcatcggcggcttcatcaaggtgcgccagtacgaccagatcctgatcgagatctgcggcaagaaggccatcggcaccgtgctggtgggccccacccccgtgaacatcatcggccgcaacatgctgacccagctgggctgcaccctgaacttccccatctcccccatcgagaccgtgcccgtgaagctgaagcccggcatggacggccccaaggtgaagcagtggcccctgaccgaggagaagatcaaggccctgaccgccatctgcgaggagatggagaaggagggcaagatcaccaagatcggccccgagaacccctacaacacccccgtgttcgccatcaagaagaaggactccaccaagtggcgcaagctggtggacttccgcgagctgaacaagcgcacccaggacttctgggaggtgcagctgggcatcccccaccccgccggcctgaagaagaagaagtccgtgaccgtgctggacgtgggcgacgcctacttctccgtgcccctggacgagggcttccgcaagtacaccgccttcaccatcccctccatcaacaacgagacccccggcatccgctaccagtacaacgtgctgccccagggctggaagggctcccccgccatcttccagtcctccatgaccaagatcctggagcccttccgcgcccagaaccccgagatcgtgatctaccagtacatggacgacctgtacgtgggctccgacctggagatcggccagcaccgcgccaagatcgaggagctgcgcgagcacctgctgaagtggggcttcaccacccccgacaagaagcaccagaaggagccccccttcctgtggatgggctacgagctgcaccccgacaagtggaccgtgcagcccatccagctgcccgagaaggactcctggaccgtgaacgacatccagaagctggtgggcaagctgaactgggcctcccagatctaccccggcatcaaggtgcgccagctgtgcaagctgctgcgcggcgccaaggccctgaccgacatcgtgcccctgaccgaggaggccgagctggagctggccgagaaccgcgagatcctgaaggagcccgtgcacggcgtgtactacgacccctccaaggacctgatcgccgagatccagaagcagggccacgaccagtggacctaccagatctaccaggagcccttcaagaacctgaagaccggcaagtacgccaagatgcgcaccgcccacaccaacgacgtgaagcagctgaccgaggccgtgcagaagatcgccatggagtccatcgtgatctggggcaagacccccaagttccgcctgcccatccagaaggagacctgggagacctggtggaccgactactggcaggccacctggatccccgagtgggagttcgtgaacaccccccccctggtgaagctgtggtaccagctggagaaggagcccatcgccggcgccgagaccttctacgtggacggcgccgccaaccgcgagaccaagatcggcaaggccggctacgtgaccgaccgcggccgccagaagatcgtgtccctgaccgagaccaccaaccagaagaccgagctgcaggccatccagctggccctgcaggactccggctccgaggtgaacatcgtgaccgactcccagtacgccctgggcatcatccaggcccagcccgacaagtccgagtccgagctggtgaaccagatcatcgagcagctgatcaagaaggagaaggtgtacctgtcctgggtgcccgcccacaagggcatcggcggcaacgagcaggtggacaagctggtgtcctccggcatccgcaaggtgctgttcctggacggcatcgacaaggcccaggaggagcacgagaagtaccactccaactggcgcgccatggcctccgagttcaacctgccccccatcgtggccaaggagatcgtggcctcctgcgacaagtgccagctgaagggcgaggccatgcacggccaggtggactgctcccccggcatctggcagctggactgcacccacctggagggcaagatcatcctggtggccgtgcacgtggcctccggctacatcgaggccgaggtgatccccgccgagaccggccaggagaccgcctacttcatcctgaagctggccggccgctggcccgtgaaggtgatccacaccgacaacggctccaacttcacctccgccgccgtgaaggccgcctgctggtgggccggcatccagcaggagttcggcatcccctacaacccccagtcccagggcgtggtggagtccatgaacaaggagctgaagaagatcatcggccaggtgcgcgaccaggccgagcacctgaagaccgccgtgcagatggccgtgttcatccacaacttcaagcgcaagggcggcatcggcggctactccgccggcgagcgcatcatcgacatcatcgccaccgacatccagaccaaggagctgcagaagcagatcatcaagatccagaacttccgcgtgtactaccgcgactcccgcgaccccatctggaagggccccgccaagctgctgtggaagggcgagggcgccgtggtgatccaggacaactccgacatcaaggtggtgccccgccgcaaggccaagatcatccgcgactacggcaagcagatggccggcgccgactgcgtggccggccgccaggacgaggactaa

SEQ ID NO: 232 - protein, 1002 aa, Human immunodeficiency virus
FFRENLAFPQGKAGELSSEQTRANSPTSRELRVWGGDNPLSETGAERQGTVSFNFPQITLWQRPLVTIKIGGQLKEALLDTGADDTVLEEINLPGKWKPKMIGGIGGFIKVRQYDQILIEICGHKAIGTVLVGPTPVNIIGRNLLTQIGCTLNFPISPIETVPVKLKPGMDGPKVKQWPLTEEKIKALTEICTEMEKEGKISRIGPENPYNTPIFAIKKKDSTKWRKLVDFRELNKRTQDFWEVQLGIPHPAGLKKKKSVTVLDVGDAYFSVPLDEDFRKYTAFTIPSINNETPGIRYQYNVLPQGWKGSPAIFQSSMTKILEPFRKQNPEIVIYQYMDDLYVGSDLEIGQHRTKIEELREHLLRWGFTTPDKKHQKEPPFLWMGYELHPDKWTVQPIKLPEKESWTVNDIQKLVGKLNWASQIYPGIKVRQLCKLLRGTKALTEVIPLTEEAELELAENREILKEPVHGVYYDPSKDLIAEIQKQGQGQWTYQIYQEPFKNLKTGKYARMRGAHTNDVKQLTEAVQKIAIESIVIWGKTPKFRLPIQKETWETWWTEYWQATWIPEWEFVNTPPLVKLWYQLEKEPIIGAETFYVDGAANRETKLGKAGYVTDRGRQKVVPLTDTTNQKTELQAINLALQDSGLEVNIVTDSQYALGIIQAQPDKSESELVSQIIEQLIKKEKVYLAWVPAHKGIGGNEQVDKLVSNGIRKVLFLDGIDKAQEEHEKYHNNWRAMASDFNLPPVVAKEIVASCDKCQLKGEAMHGQVDCSPGIWQLDCTHLEGKVILVAVHVASGYIEAEVIPAETGQETAYFLLKLAGRWPVKVVHTDNGSNFTSAAVKAACWWAGIKQEFGIPYNPQSQGVVESMNKELKKIIGQVRDQAEHLKTAVQMAVFIHNFKRKGGIGGYSAGERIIDIIATDIQTKELQKQIIKIQNFRVYYRDSRDPIWKGPAKLLWKGEGAVVIQDNSDIKVVPRRKVKIIRDYGKQMAGDDCVASRQDED

SEQ ID NO: 233 - protein, 1003 aa, Human immunodeficiency virus
FFRENLAFQQGEARKFPSEQTRANSPASRELRVQRGDNPLSEAGAERRGTVPSLSFPQITLWQRPLVTIKIGGQLKEALLDTGADDTVLEDINLPGKWKPKMIGGIGGFIKVKQYDHILIEICGHKAIGTVLVGPTPVNIIGRNMLTQIGCTLNFPISPIETVPVKLKPGMDGPKVKQWPLTEEKIKALTEICTEMEKEGKISKIGPENPYNTPVFAIKKKDSTKWRKLVDFRELNKRTQDFWEVQLGIPHPAGLKKKKSVTVLDVGDAYFSVPLDKDFRKYTAFTIPSVNNETPGIRYQYNVLPQGWKGSPAIFQCSMTKILEPFRTKNPDIVIYQYMDDLYVGSDLEIGQHRTKIEELREHLLKWGFTTPDKKHQKEPPFLWMGYELHPDKWTVQPIQLPDKDSWTVNDIQKLVGKLNWASQIYPGIKVKQLCKLLRGAKALTDIVPLTAEAELELAENREILKEPVHGVYYDPSKDLIAEIQKQGQGQWTYQIYQEPFKNLKTGKYAKMRSAHTNDVKQLTEAVQKIALESIVIWGKTPKFRLPILKETWDTWWTDYWQATWIPEWEFVNTPPLVKLWYQLETEPIVGAETFYVDGASNRETKKGKAGYVTDRGRQKVVSLTETTNQKAELQAIHLALQDSGSEVNIVTDSQYALGIIQAQPDKSESELVNQIIEQLIQKEKVYLSWVPAHKGIGGNEQVDKLVSAGIRKILFLDGIDKAQEEHEKYHNNWRAMASDFNLPPVVAKEIVASCDKCQLKGEAMHGQVDCSPGIWQLDCTHLEGKIILVAVHVASGYIEAEVIPAETGQETAYFILKLAGRWPVKIIHTDNGSNFTSAAVKAACWWAGIQQEFGIPYNPQSQGVVESMNKELKKIIGQVRDQAEHLKTAVQMAVFIHNFKRKGGIGGYSAGERIIDIIATDIQTRELQKQITKIQNFRVYYRDSRDPVWKGPAKLLWKGEGAVVIQDNSEIKVVPRRKAKIIRDYGKQMAGDDCVAGRQDED

SEQ ID NO: 234 - DNA, 3009 bp, Human immunodeficiency virus
ttcttccgcgagaacctggccttcccccagggcaaggccggcgagctgtcctccgagcagacccgcgccaactcccccacctcccgcgagctgcgcgtgtggggcggcgacaaccccctgtccgagaccggcgccgagcgccagggcaccgtgtccttcaacttcccccagatcaccctgtggcagcgccccctggtgaccatcaagatcggcggccagctgaaggaggccctgctggacaccggcgccgacgacaccgtgctggaggagatcaacctgcccggcaagtggaagcccaagatgatcggcggcatcggcggcttcatcaaggtgcgccagtacgaccagatcctgatcgagatctgcggccacaaggccatcggcaccgtgctggtgggccccacccccgtgaacatcatcggccgcaacctgctgacccagatcggctgcaccctgaacttccccatctcccccatcgagaccgtgcccgtgaagctgaagcccggcatggacggccccaaggtgaagcagtggcccctgaccgaggagaagatcaaggccctgaccgagatctgcaccgagatggagaaggagggcaagatctcccgcatcggccccgagaacccctacaacacccccatcttcgccatcaagaagaaggactccaccaagtggcgcaagctggtggacttccgcgagctgaacaagcgcacccaggacttctgggaggtgcagctgggcatcccccaccccgccggcctgaagaagaagaagtccgtgaccgtgctggacgtgggcgacgcctacttctccgtgcccctggacgaggacttccgcaagtacaccgccttcaccatcccctccatcaacaacgagacccccggcatccgctaccagtacaacgtgctgccccagggctggaagggctcccccgccatcttccagtcctccatgaccaagatcctggagcccttccgcaagcagaaccccgagatcgtgatctaccagtacatggacgacctgtacgtgggctccgacctggagatcggccagcaccgcaccaagatcgaggagctgcgcgagcacctgctgcgctggggcttcaccacccccgacaagaagcaccagaaggagccccccttcctgtggatgggctacgagctgcaccccgacaagtggaccgtgcagcccatcaagctgcccgagaaggagtcctggaccgtgaacgacatccagaagctggtgggcaagctgaactgggcctcccagatctaccccggcatcaaggtgcgccagctgtgcaagctgctgcgcggcaccaaggccctgaccgaggtgatccccctgaccgaggaggccgagctggagctggccgagaaccgcgagatcctgaaggagcccgtgcacggcgtgtactacgacccctccaaggacctgatcgccgagatccagaagcagggccagggccagtggacctaccagatctaccaggagcccttcaagaacctgaagaccggcaagtacgcccgcatgcgcggcgcccacaccaacgacgtgaagcagctgaccgaggccgtgcagaagatcgccatcgagtccatcgtgatctggggcaagacccccaagttccgcctgcccatccagaaggagacctgggagacctggtggaccgagtactggcaggccacctggatccccgagtgggagttcgtgaacaccccccccctggtgaagctgtggtaccagctggagaaggagcccatcatcggcgccgagaccttctacgtggacggcgccgccaaccgcgagaccaagctgggcaaggccggctacgtgaccgaccgcggccgccagaaggtggtgcccctgaccgacaccaccaaccagaagaccgagctgcaggccatcaacctggccctgcaggactccggcctggaggtgaacatcgtgaccgactcccagtacgccctgggcatcatccaggcccagcccgacaagtccgagtccgagctggtgtcccagatcatcgagcagctgatcaagaaggagaaggtgtacctggcctgggtgcccgcccacaagggcatcggcggcaacgagcaggtggacaagctggtgtccaacggcatccgcaaggtgctgttcctggacggcatcgacaaggcccaggaggagcacgagaagtaccacaacaactggcgcgccatggcctccgacttcaacctgccccccgtggtggccaaggagatcgtggcctcctgcgacaagtgccagctgaagggcgaggccatgcacggccaggtggactgctcccccggcatctggcagctggactgcacccacctggagggcaaggtgatcctggtggccgtgcacgtggcctccggctacatcgaggccgaggtgatccccgccgagaccggccaggagaccgcctacttcctgctgaagctggccggccgctggcccgtgaaggtggtgcacaccgacaacggctccaacttcacctccgccgccgtgaaggccgcctgctggtgggccggcatcaagcaggagttcggcatcccctacaacccccagtcccagggcgtggtggagtccatgaacaaggagctgaagaagatcatcggccaggtgcgcgaccaggccgagcacctgaagaccgccgtgcagatggccgtgttcatccacaacttcaagcgcaagggcggcatcggcggctactccgccggcgagcgcatcatcgacatcatcgccaccgacatccagaccaaggagctgcagaagcagatcatcaagatccagaacttccgcgtgtactaccgcgactcccgcgaccccatctggaagggccccgccaagctgctgtggaagggcgagggcgccgtggtgatccaggacaactccgacatcaaggtggtgccccgccgcaaggtgaagatcatccgcgactacggcaagcagatggccggcgacgactgcgtggcctcccgccaggacgaggactaa

SEQ ID NO: 235 - DNA, 3012 bp, Human immunodeficiency virus
ttcttccgcgagaacctggccttccagcagggcgaggcccgcaagttcccctccgagcagacccgcgccaactcccccgcctcccgcgagctgcgcgtgcagcgcggcgacaaccccctgtccgaggccggcgccgagcgccgcggcaccgtgccctccctgtccttcccccagatcaccctgtggcagcgccccctggtgaccatcaagatcggcggccagctgaaggaggccctgctggacaccggcgccgacgacaccgtgctggaggacatcaacctgcccggcaagtggaagcccaagatgatcggcggcatcggcggcttcatcaaggtgaagcagtacgaccacatcctgatcgagatctgcggccacaaggccatcggcaccgtgctggtgggccccacccccgtgaacatcatcggccgcaacatgctgacccagatcggctgcaccctgaacttccccatctcccccatcgagaccgtgcccgtgaagctgaagcccggcatggacggccccaaggtgaagcagtggcccctgaccgaggagaagatcaaggccctgaccgagatctgcaccgagatggagaaggagggcaagatctccaagatcggccccgagaacccctacaacacccccgtgttcgccatcaagaagaaggactccaccaagtggcgcaagctggtggacttccgcgagctgaacaagcgcacccaggacttctgggaggtgcagctgggcatcccccaccccgccggcctgaagaagaagaagtccgtgaccgtgctggacgtgggcgacgcctacttctccgtgcccctggacaaggacttccgcaagtacaccgccttcaccatcccctccgtgaacaacgagacccccggcatccgctaccagtacaacgtgctgccccagggctggaagggctcccccgccatcttccagtgctccatgaccaagatcctggagcccttccgcaccaagaaccccgacatcgtgatctaccagtacatggacgacctgtacgtgggctccgacctggagatcggccagcaccgcaccaagatcgaggagctgcgcgagcacctgctgaagtggggcttcaccacccccgacaagaagcaccagaaggagccccccttcctgtggatgggctacgagctgcaccccgacaagtggaccgtgcagcccatccagctgcccgacaaggactcctggaccgtgaacgacatccagaagctggtgggcaagctgaactgggcctcccagatctaccccggcatcaaggtgaagcagctgtgcaagctgctgcgcggcgccaaggccctgaccgacatcgtgcccctgaccgccgaggccgagctggagctggccgagaaccgcgagatcctgaaggagcccgtgcacggcgtgtactacgacccctccaaggacctgatcgccgagatccagaagcagggccagggccagtggacctaccagatctaccaggagcccttcaagaacctgaagaccggcaagtacgccaagatgcgctccgcccacaccaacgacgtgaagcagctgaccgaggccgtgcagaagatcgccctggagtccatcgtgatctggggcaagacccccaagttccgcctgcccatcctgaaggagacctgggacacctggtggaccgactactggcaggccacctggatccccgagtgggagttcgtgaacaccccccccctggtgaagctgtggtaccagctggagaccgagcccatcgtgggcgccgagaccttctacgtggacggcgcctccaaccgcgagaccaagaagggcaaggccggctacgtgaccgaccgcggccgccagaaggtggtgtccctgaccgagaccaccaaccagaaggccgagctgcaggccatccacctggccctgcaggactccggctccgaggtgaacatcgtgaccgactcccagtacgccctgggcatcatccaggcccagcccgacaagtccgagtccgagctggtgaaccagatcatcgagcagctgatccagaaggagaaggtgtacctgtcctgggtgcccgcccacaagggcatcggcggcaacgagcaggtggacaagctggtgtccgccggcatccgcaagatcctgttcctggacggcatcgacaaggcccaggaggagcacgagaagtaccacaacaactggcgcgccatggcctccgacttcaacctgccccccgtggtggccaaggagatcgtggcctcctgcgacaagtgccagctgaagggcgaggccatgcacggccaggtggactgctcccccggcatctggcagctggactgcacccacctggagggcaagatcatcctggtggccgtgcacgtggcctccggctacatcgaggccgaggtgatccccgccgagaccggccaggagaccgcctacttcatcctgaagctggccggccgctggcccgtgaagatcatccacaccgacaacggctccaacttcacctccgccgccgtgaaggccgcctgctggtgggccggcatccagcaggagttcggcatcccctacaacccccagtcccagggcgtggtggagtccatgaacaaggagctgaagaagatcatcggccaggtgcgcgaccaggccgagcacctgaagaccgccgtgcagatggccgtgttcatccacaacttcaagcgcaagggcggcatcggcggctactccgccggcgagcgcatcatcgacatcatcgccaccgacatccagacccgcgagctgcagaagcagatcaccaagatccagaacttccgcgtgtactaccgcgactcccgcgaccccgtgtggaagggccccgccaagctgctgtggaagggcgagggcgccgtggtgatccaggacaactccgagatcaaggtggtgccccgccgcaaggccaagatcatccgcgactacggcaagcagatggccggcgacgactgcgtggccggccgccaggacgaggactaa

SEQ ID NO: 236 - protein, 1003 aa, Human immunodeficiency virus
FFRENLAFQQGEARKFSSEQTRANSPASRELRVRRGDNSLPEAGAERQGTGSSLDFPQITLWQRPLVTIKVGGQLREALLDTGADDTVLEDINLPGKWKPKMIGGIGGFIKVRQYDQIPIEICGQKAIGTVLVGPTPVNIIGRNMLTQIGCTLNFPISPIETVPVKLKPGMDGPKVKQWPLTEEKIKALTEICTEMEKEGKISKIGPENPYNTPVFAIKKKDSTKWRKLVDFRELNKRTQDFWEVQLGIPHPAGLKKKKSVTVLDVGDAYFSVPLDKEFRKYTAFTIPSINNETPGIRYQYNVLPQGWKGSPAIFQSSMTKILEPFRAKNPEIVIYQYMDDLYVGSDLEIGQHRTKIEELREHLLRWGFTTPDKKHQKEPPFLWMGYELHPDKWTVQAIQLPDKSSWTVNDIQKLVGKLNWASQIYPGIRVKHLCKLLRGAKALTDVVPLTAEAELELAENREILKEPVHGVYYDPSKDLIAEIQKQGHDQWTYQIYQEPHKNLKTGKYARRKSAHTNDVKQLTEVVQKIATEGIVIWGKVPKFRLPIQKETWEIWWTEYWQATWIPEWEFVNTPPLVKLWYQLETEPIVGAETFYVDGAANRETKLGKAGYVTDRGRQKVVPLTETTNQKTELQAIHLALQDSGSEVNIVTDSQYALGIIQAHPDKSESELVNQIIEQLIQKERVYLSWVPAHKGIGGNEQVDKLVSTGIRKVLFLDGIDKAQEEHEKYHSNWRAMASDFNLPPVVAKEIVASCDKCQLKGEAMHGQVDCSPGIWQLDCTHLEGKIILVAVHVASGYIEAEVIPAETGQETAYFILKLAGRWPVKIIHTDNGSNFTSTVVKAACWWAGIQQEFGIPYNPQSQGVVESMNKELKKIIGQVRDQAEHLKTAVQMAVFIHNFKRKGGIGGYSAGERIIDIIATDIQTKELQKQITKIQNFRVYFRDSRDPVWKGPAKLLWKGEGAVVIQDNNEIKVVPRRKAKIIRDYGKQMAGDDCVAGRQDED

SEQ ID NO: 237 - protein, 1002 aa, Human immunodeficiency virus
FFRENLAFQQGEAREFSSEQARANSPTRRELRVRRGDSPLPEAGAEGKGAISLSFPQITLWQRPLVTVKIGGQLIEALLDTGADDTVLEEINLPGKWKPKMIGGIGGFIKVRQYDQILIEISGKKAIGTVLVGPTPINIIGRNMLTQIGCTLNFPISPIETVPVKLKPGMDGPKVKQWPLTEEKIKALTEICTEMEKEGKISKIGPENPYNTPIFAIKKKDSTKWRKLVDFRELNKRTQDFWEVQLGIPHPAGLKKKKSVTVLDVGDAYFSVPLDENFRKYTAFTIPSTNNETPGIRYQYNVLPQGWKGSPAIFQSSMTKILEPFRTKNPEIVIYQYMDDLYVGSDLEIGQHRAKIEELREHLLRWGFTTPDKKHQKEPPFLWMGYELHPDKWTVQPIQLPDKESWTVNDIQKLVGKLNWASQIYPGIKVKQLCKLLRGAKALTDIVPLTAEAELELAENREILKEPVHGVYYDPSKELIAEVQKQGLDQWTYQIYQEPYKNLKTGKYAKRGSAHTNDVKQLTEVVQKIATESIVIWGKTPKFKLPIRKETWEVWWTEYWQATWIPEWEFVNTPPLVKLWYRLETEPIPGAETYYVDGAANRETKLGKAGYVTDKGKQKIITLTETTNQKAELQAIHLALQDSGSEVNIVTDSQYALGIIQAQPDRSESELVNQIIEQLIKKEKVYLSWVPAHKGIGGNEQVDKLVSSGIRKVLFLDGIDKAQEEHERYHSNWRAMASDFNLPPIVAKEIVASCDKCQLKGEAMHGQVDCSPGIWQLDCTHLEGKIILVAVHVASGYIEAEVIPAETGQETAYFILKLAGRWPVKVIHTDNGSNFTSAAVKAACWWANITQEFGIPYNPQSQGVVESMNKELKKIIGQVRDQAEHLKTAVQMAVFIHNFKRKGGIGGYSAGERIIDIIASDIQTKELQKQITKIQNFRVYYRDSRDPIWKGPAKLLWKGEGAVVIQDNNEIKVVPRRKAKIIRDYGKQMAGDDCVAGRQDED

SEQ ID NO: 238 - DNA, 3012 bp, Human immunodeficiency virus
ttcttccgcgagaacctggccttccagcagggcgaggcccgcaagttctcctccgagcagacccgcgccaactcccccgcctcccgcgagctgcgcgtgcgccgcggcgacaactccctgcccgaggccggcgccgagcgccagggcaccggctcctccctggacttcccccagatcaccctgtggcagcgccccctggtgaccatcaaggtgggcggccagctgcgcgaggccctgctggacaccggcgccgacgacaccgtgctggaggacatcaacctgcccggcaagtggaagcccaagatgatcggcggcatcggcggcttcatcaaggtgcgccagtacgaccagatccccatcgagatctgcggccagaaggccatcggcaccgtgctggtgggccccacccccgtgaacatcatcggccgcaacatgctgacccagatcggctgcaccctgaacttccccatctcccccatcgagaccgtgcccgtgaagctgaagcccggcatggacggccccaaggtgaagcagtggcccctgaccgaggagaagatcaaggccctgaccgagatctgcaccgagatggagaaggagggcaagatctccaagatcggccccgagaacccctacaacacccccgtgttcgccatcaagaagaaggactccaccaagtggcgcaagctggtggacttccgcgagctgaacaagcgcacccaggacttctgggaggtgcagctgggcatcccccaccccgccggcctgaagaagaagaagtccgtgaccgtgctggacgtgggcgacgcctacttctccgtgcccctggacaaggagttccgcaagtacaccgccttcaccatcccctccatcaacaacgagacccccggcatccgctaccagtacaacgtgctgccccagggctggaagggctcccccgccatcttccagtcctccatgaccaagatcctggagcccttccgcgccaagaaccccgagatcgtgatctaccagtacatggacgacctgtacgtgggctccgacctggagatcggccagcaccgcaccaagatcgaggagctgcgcgagcacctgctgcgctggggcttcaccacccccgacaagaagcaccagaaggagccccccttcctgtggatgggctacgagctgcaccccgacaagtggaccgtgcaggccatccagctgcccgacaagtcctcctggaccgtgaacgacatccagaagctggtgggcaagctgaactgggcctcccagatctaccccggcatccgcgtgaagcacctgtgcaagctgctgcgcggcgccaaggccctgaccgacgtggtgcccctgaccgccgaggccgagctggagctggccgagaaccgcgagatcctgaaggagcccgtgcacggcgtgtactacgacccctccaaggacctgatcgccgagatccagaagcagggccacgaccagtggacctaccagatctaccaggagccccacaagaacctgaagaccggcaagtacgcccgccgcaagtccgcccacaccaacgacgtgaagcagctgaccgaggtggtgcagaagatcgccaccgagggcatcgtgatctggggcaaggtgcccaagttccgcctgcccatccagaaggagacctgggagatctggtggaccgagtactggcaggccacctggatccccgagtgggagttcgtgaacaccccccccctggtgaagctgtggtaccagctggagaccgagcccatcgtgggcgccgagaccttctacgtggacggcgccgccaaccgcgagaccaagctgggcaaggccggctacgtgaccgaccgcggccgccagaaggtggtgcccctgaccgagaccaccaaccagaagaccgagctgcaggccatccacctggccctgcaggactccggctccgaggtgaacatcgtgaccgactcccagtacgccctgggcatcatccaggcccaccccgacaagtccgagtccgagctggtgaaccagatcatcgagcagctgatccagaaggagcgcgtgtacctgtcctgggtgcccgcccacaagggcatcggcggcaacgagcaggtggacaagctggtgtccaccggcatccgcaaggtgctgttcctggacggcatcgacaaggcccaggaggagcacgagaagtaccactccaactggcgcgccatggcctccgacttcaacctgccccccgtggtggccaaggagatcgtggcctcctgcgacaagtgccagctgaagggcgaggccatgcacggccaggtggactgctcccccggcatctggcagctggactgcacccacctggagggcaagatcatcctggtggccgtgcacgtggcctccggctacatcgaggccgaggtgatccccgccgagaccggccaggagaccgcctacttcatcctgaagctggccggccgctggcccgtgaagatcatccacaccgacaacggctccaacttcacctccaccgtggtgaaggccgcctgctggtgggccggcatccagcaggagttcggcatcccctacaacccccagtcccagggcgtggtggagtccatgaacaaggagctgaagaagatcatcggccaggtgcgcgaccaggccgagcacctgaagaccgccgtgcagatggccgtgttcatccacaacttcaagcgcaagggcggcatcggcggctactccgccggcgagcgcatcatcgacatcatcgccaccgacatccagaccaaggagctgcagaagcagatcaccaagatccagaacttccgcgtgtacttccgcgactcccgcgaccccgtgtggaagggccccgccaagctgctgtggaagggcgagggcgccgtggtgatccaggacaacaacgagatcaaggtggtgccccgccgcaaggccaagatcatccgcgactacggcaagcagatggccggcgacgactgcgtggccggccgccaggacgaggactaa

SEQ ID NO: 239 - DNA, 3009 bp, Human immunodeficiency virus
ttcttccgcgagaacctggccttccagcagggcgaggcccgcgagttctcctccgagcaggcccgcgccaactcccccacccgccgcgagctgcgcgtgcgccgcggcgactcccccctgcccgaggccggcgccgagggcaagggcgccatctccctgtccttcccccagatcaccctgtggcagcgccccctggtgaccgtgaagatcggcggccagctgatcgaggccctgctggacaccggcgccgacgacaccgtgctggaggagatcaacctgcccggcaagtggaagcccaagatgatcggcggcatcggcggcttcatcaaggtgcgccagtacgaccagatcctgatcgagatctccggcaagaaggccatcggcaccgtgctggtgggccccacccccatcaacatcatcggccgcaacatgctgacccagatcggctgcaccctgaacttccccatctcccccatcgagaccgtgcccgtgaagctgaagcccggcatggacggccccaaggtgaagcagtggcccctgaccgaggagaagatcaaggccctgaccgagatctgcaccgagatggagaaggagggcaagatctccaagatcggccccgagaacccctacaacacccccatcttcgccatcaagaagaaggactccaccaagtggcgcaagctggtggacttccgcgagctgaacaagcgcacccaggacttctgggaggtgcagctgggcatcccccaccccgccggcctgaagaagaagaagtccgtgaccgtgctggacgtgggcgacgcctacttctccgtgcccctggacgagaacttccgcaagtacaccgccttcaccatcccctccaccaacaacgagacccccggcatccgctaccagtacaacgtgctgccccagggctggaagggctcccccgccatcttccagtcctccatgaccaagatcctggagcccttccgcaccaagaaccccgagatcgtgatctaccagtacatggacgacctgtacgtgggctccgacctggagatcggccagcaccgcgccaagatcgaggagctgcgcgagcacctgctgcgctggggcttcaccacccccgacaagaagcaccagaaggagccccccttcctgtggatgggctacgagctgcaccccgacaagtggaccgtgcagcccatccagctgcccgacaaggagtcctggaccgtgaacgacatccagaagctggtgggcaagctgaactgggcctcccagatctaccccggcatcaaggtgaagcagctgtgcaagctgctgcgcggcgccaaggccctgaccgacatcgtgcccctgaccgccgaggccgagctggagctggccgagaaccgcgagatcctgaaggagcccgtgcacggcgtgtactacgacccctccaaggagctgatcgccgaggtgcagaagcagggcctggaccagtggacctaccagatctaccaggagccctacaagaacctgaagaccggcaagtacgccaagcgcggctccgcccacaccaacgacgtgaagcagctgaccgaggtggtgcagaagatcgccaccgagtccatcgtgatctggggcaagacccccaagttcaagctgcccatccgcaaggagacctgggaggtgtggtggaccgagtactggcaggccacctggatccccgagtgggagttcgtgaacaccccccccctggtgaagctgtggtaccgcctggagaccgagcccatccccggcgccgagacctactacgtggacggcgccgccaaccgcgagaccaagctgggcaaggccggctacgtgaccgacaagggcaagcagaagatcatcaccctgaccgagaccaccaaccagaaggccgagctgcaggccatccacctggccctgcaggactccggctccgaggtgaacatcgtgaccgactcccagtacgccctgggcatcatccaggcccagcccgaccgctccgagtccgagctggtgaaccagatcatcgagcagctgatcaagaaggagaaggtgtacctgtcctgggtgcccgcccacaagggcatcggcggcaacgagcaggtggacaagctggtgtcctccggcatccgcaaggtgctgttcctggacggcatcgacaaggcccaggaggagcacgagcgctaccactccaactggcgcgccatggcctccgacttcaacctgccccccatcgtggccaaggagatcgtggcctcctgcgacaagtgccagctgaagggcgaggccatgcacggccaggtggactgctcccccggcatctggcagctggactgcacccacctggagggcaagatcatcctggtggccgtgcacgtggcctccggctacatcgaggccgaggtgatccccgccgagaccggccaggagaccgcctacttcatcctgaagctggccggccgctggcccgtgaaggtgatccacaccgacaacggctccaacttcacctccgccgccgtgaaggccgcctgctggtgggccaacatcacccaggagttcggcatcccctacaacccccagtcccagggcgtggtggagtccatgaacaaggagctgaagaagatcatcggccaggtgcgcgaccaggccgagcacctgaagaccgccgtgcagatggccgtgttcatccacaacttcaagcgcaagggcggcatcggcggctactccgccggcgagcgcatcatcgacatcatcgcctccgacatccagaccaaggagctgcagaagcagatcaccaagatccagaacttccgcgtgtactaccgcgactcccgcgaccccatctggaagggccccgccaagctgctgtggaagggcgagggcgccgtggtgatccaggacaacaacgagatcaaggtggtgccccgccgcaaggccaagatcatccgcgactacggcaagcagatggccggcgacgactgcgtggccggccgccaggacgaggactaa

SEQ ID NO: 240 - protein, 1001 aa, Human immunodeficiency virus
FFRENLAFQQREARKFSPEQARANSPTSRELRVRRGDDPLSEAGAEGQGTSLSFPQITLWQRPLVTVKIEGQLREALLDTGADDTVLEEINLPGKWKPKMIGGIGGFIKVRQYEQVAIEICGKKAIGTVLVGPTPVNIIGRNILTQIGCTLNFPISPIETVPVKLKPGMDGPKVKQWPLTEEKIKALTEICIEMEKEGKISKIGPENPYNTPIFAIKKKDSTKWRKLVDFRELNKRTQDFWEVQLGIPHPAGLKKKKSVSVLDVGDAYFSVPLDKDFRKYTAFTIPSINNETPGIRYQYNVLPQGWKGSPAIFQSSMTKILEPFRKQNPEMIIYQYMDDLYVGSDLEIGQHRAKIEELRAHLLRWGFTTPDKKHQKEPPFLWMGYELHPDKWTVQPVKLPEKDSWTVNDIQKLVGKLNWASQIYPGIKVKQLCKLLRGAKALTDIVPLTKEAELELAENREILREPVHGVYYDPSKDLIAEIQKQGPDQWTYQIYQEPFKNLKTGKYAKMRTAHTNDVKQLTEAVQKIATESIVIWGKIPKFRLPIQKETWETWWTEHWQATWIPEWEFVNTPHLVKLWYQLETEPIAGAETYYVDGAANRETKIGKAGYVTDRGKQKVVSLTETTNQKTELQAIYLALQDSGLEVNIVTDSQYALGIIQAQPDKSESELVNQIIEELIKKEKVYLSWVPAHKGIGGNEQVDKLVSSGIRKVLFLDGIDKAQEEHERYHNNWRAMASDFNLPPIVAKEIVASCDKCQLKGEAMHGQVDCSPGIWQLDCTHLEGKVILVAVHVASGYIEAEVIPAETGQETAYFILKLAGRWPVKMIHTDNGSNFTSAAVKAACWWADIQQEFGIPYNPQSQGVVESMNKELKKIIGQVRDQAEHLRTAVQMAVFIHNFKRKGGIGGYSAGERIIDIIATDIQTKELQKQISKIQKFRVYYRDSRDPIWKGPAKLLWKGEGAVVIQDNSEIKVVPRRKAKIIRDYGKQMAGDDCVAGRQDED

SEQ ID NO: 241 - protein, 1003 aa, Human immunodeficiency virus
FFRENLAFQQGKAGEFSSEQTRANSPTSRKLGDGGRDNLLTEAGAERQGTSSSFSFPQITLWQRPLVTVKIGGQLKEALLDTGADDTVLEDINLPGKWKPKMIGGIGGFIKVRQYDQILIEICGKKAIGTVLVGPTPVNIIGRNMLTQIGCTLNFPISPIDTVPVTLKPGMDGPKVKQWPLTEEKIKALTEICKEMEEEGKISKIGPENPYNTPVFAIKKKDSTKWRKLVDFRELNKRTQDFWEVQLGIPHPAGLKKKKSVTVLDVGDAYFSVPLDESFRKYTAFTIPSINNETPGIRYQYNVLPQGWKGSPAIFQSSMTKILEPFRIKNPEMVIYQYMDDLYVGSDLEIGQHRTKIEELRAHLLSWGFTTPDKKHQKEPPFLWMGYELHPDRWTVQPIELPEKDSWTVNDIQKLVGKLNWASQIYAGIKVKQLCKLLRGAKALTDIVPLTEEAELELAENREILKTPVHGVYYDPSKDLVAEVQKQGQDQWTYQIYQEPFKNLKTGKYARKRSAHTNDVRQLTEVVQKIATESIVIWGKTPKFRLPIQRETWETWWMEYWQATWIPEWEFVNTPPLVKLWYQLEKDPIVGAETFYVDGAASRETKLGKAGYVTDRGRQKVVSLTETTNQKTELHAIHLALQDSGSEVNIVTDSQYALGIIQAQPDRSESEVVNQIIEELIKKEKVYLSWVPAHKGIGGNEQVDKLVSSGIRKVLFLDGIDKAQEEHERYHSNWRTMASDFNLPPIVAKEIVANCDKCQLKGEAMHGQVDCSPGIWQLDCTHLEGKVILVAVHVASGYIEAEVIPAETGQETAYFLLKLAGRWPVKVIHTDNGSNFTSAAVKAACWWANVRQEFGIPYNPQSQGVVESMNKELKKIIGQVREQAEHLKTAVQMAVFIHNFKRKGGIGGYSAGERIIDIIATDIQTKELQKQITKIQNFRVYYRDSRDPIWKGPAKLLWKGEGAVVIQDNSDIKVVPRRKAKIIRDYGKQMAGDDCVAGRQDED

SEQ ID NO: 242 - DNA, 3006 bp, Human immunodeficiency virus
ttcttccgcgagaacctggccttccagcagcgcgaggcccgcaagttctcccccgagcaggcccgcgccaactcccccacctcccgcgagctgcgcgtgcgccgcggcgacgaccccctgtccgaggccggcgccgagggccagggcacctccctgtccttcccccagatcaccctgtggcagcgccccctggtgaccgtgaagatcgagggccagctgcgcgaggccctgctggacaccggcgccgacgacaccgtgctggaggagatcaacctgcccggcaagtggaagcccaagatgatcggcggcatcggcggcttcatcaaggtgcgccagtacgagcaggtggccatcgagatctgcggcaagaaggccatcggcaccgtgctggtgggccccacccccgtgaacatcatcggccgcaacatcctgacccagatcggctgcaccctgaacttccccatctcccccatcgagaccgtgcccgtgaagctgaagcccggcatggacggccccaaggtgaagcagtggcccctgaccgaggagaagatcaaggccctgaccgagatctgcatcgagatggagaaggagggcaagatctccaagatcggccccgagaacccctacaacacccccatcttcgccatcaagaagaaggactccaccaagtggcgcaagctggtggacttccgcgagctgaacaagcgcacccaggacttctgggaggtgcagctgggcatcccccaccccgccggcctgaagaagaagaagtccgtgtccgtgctggacgtgggcgacgcctacttctccgtgcccctggacaaggacttccgcaagtacaccgccttcaccatcccctccatcaacaacgagacccccggcatccgctaccagtacaacgtgctgccccagggctggaagggctcccccgccatcttccagtcctccatgaccaagatcctggagcccttccgcaagcagaaccccgagatgatcatctaccagtacatggacgacctgtacgtgggctccgacctggagatcggccagcaccgcgccaagatcgaggagctgcgcgcccacctgctgcgctggggcttcaccacccccgacaagaagcaccagaaggagccccccttcctgtggatgggctacgagctgcaccccgacaagtggaccgtgcagcccgtgaagctgcccgagaaggactcctggaccgtgaacgacatccagaagctggtgggcaagctgaactgggcctcccagatctaccccggcatcaaggtgaagcagctgtgcaagctgctgcgcggcgccaaggccctgaccgacatcgtgcccctgaccaaggaggccgagctggagctggccgagaaccgcgagatcctgcgcgagcccgtgcacggcgtgtactacgacccctccaaggacctgatcgccgagatccagaagcagggccccgaccagtggacctaccagatctaccaggagcccttcaagaacctgaagaccggcaagtacgccaagatgcgcaccgcccacaccaacgacgtgaagcagctgaccgaggccgtgcagaagatcgccaccgagtccatcgtgatctggggcaagatccccaagttccgcctgcccatccagaaggagacctgggagacctggtggaccgagcactggcaggccacctggatccccgagtgggagttcgtgaacaccccccacctggtgaagctgtggtaccagctggagaccgagcccatcgccggcgccgagacctactacgtggacggcgccgccaaccgcgagaccaagatcggcaaggccggctacgtgaccgaccgcggcaagcagaaggtggtgtccctgaccgagaccaccaaccagaagaccgagctgcaggccatctacctggccctgcaggactccggcctggaggtgaacatcgtgaccgactcccagtacgccctgggcatcatccaggcccagcccgacaagtccgagtccgagctggtgaaccagatcatcgaggagctgatcaagaaggagaaggtgtacctgtcctgggtgcccgcccacaagggcatcggcggcaacgagcaggtggacaagctggtgtcctccggcatccgcaaggtgctgttcctggacggcatcgacaaggcccaggaggagcacgagcgctaccacaacaactggcgcgccatggcctccgacttcaacctgccccccatcgtggccaaggagatcgtggcctcctgcgacaagtgccagctgaagggcgaggccatgcacggccaggtggactgctcccccggcatctggcagctggactgcacccacctggagggcaaggtgatcctggtggccgtgcacgtggcctccggctacatcgaggccgaggtgatccccgccgagaccggccaggagaccgcctacttcatcctgaagctggccggccgctggcccgtgaagatgatccacaccgacaacggctccaacttcacctccgccgccgtgaaggccgcctgctggtgggccgacatccagcaggagttcggcatcccctacaacccccagtcccagggcgtggtggagtccatgaacaaggagctgaagaagatcatcggccaggtgcgcgaccaggccgagcacctgcgcaccgccgtgcagatggccgtgttcatccacaacttcaagcgcaagggcggcatcggcggctactccgccggcgagcgcatcatcgacatcatcgccaccgacatccagaccaaggagctgcagaagcagatctccaagatccagaagttccgcgtgtactaccgcgactcccgcgaccccatctggaagggccccgccaagctgctgtggaagggcgagggcgccgtggtgatccaggacaactccgagatcaaggtggtgccccgccgcaaggccaagatcatccgcgactacggcaagcagatggccggcgacgactgcgtggccggccgccaggacgaggactaa

SEQ ID NO: 243 - DNA, 3012 bp, Human immunodeficiency virus
ttcttccgcgagaacctggccttccagcagggcaaggccggcgagttctcctccgagcagacccgcgccaactcccccacctcccgcaagctgggcgacggcggccgcgacaacctgctgaccgaggccggcgccgagcgccagggcacctcctcctccttctccttcccccagatcaccctgtggcagcgccccctggtgaccgtgaagatcggcggccagctgaaggaggccctgctggacaccggcgccgacgacaccgtgctggaggacatcaacctgcccggcaagtggaagcccaagatgatcggcggcatcggcggcttcatcaaggtgcgccagtacgaccagatcctgatcgagatctgcggcaagaaggccatcggcaccgtgctggtgggccccacccccgtgaacatcatcggccgcaacatgctgacccagatcggctgcaccctgaacttccccatctcccccatcgacaccgtgcccgtgaccctgaagcccggcatggacggccccaaggtgaagcagtggcccctgaccgaggagaagatcaaggccctgaccgagatctgcaaggagatggaggaggagggcaagatctccaagatcggccccgagaacccctacaacacccccgtgttcgccatcaagaagaaggactccaccaagtggcgcaagctggtggacttccgcgagctgaacaagcgcacccaggacttctgggaggtgcagctgggcatcccccaccccgccggcctgaagaagaagaagtccgtgaccgtgctggacgtgggcgacgcctacttctccgtgcccctggacgagtccttccgcaagtacaccgccttcaccatcccctccatcaacaacgagacccccggcatccgctaccagtacaacgtgctgccccagggctggaagggctcccccgccatcttccagtcctccatgaccaagatcctggagcccttccgcatcaagaaccccgagatggtgatctaccagtacatggacgacctgtacgtgggctccgacctggagatcggccagcaccgcaccaagatcgaggagctgcgcgcccacctgctgtcctggggcttcaccacccccgacaagaagcaccagaaggagccccccttcctgtggatgggctacgagctgcaccccgaccgctggaccgtgcagcccatcgagctgcccgagaaggactcctggaccgtgaacgacatccagaagctggtgggcaagctgaactgggcctcccagatctacgccggcatcaaggtgaagcagctgtgcaagctgctgcgcggcgccaaggccctgaccgacatcgtgcccctgaccgaggaggccgagctggagctggccgagaaccgcgagatcctgaagacccccgtgcacggcgtgtactacgacccctccaaggacctggtggccgaggtgcagaagcagggccaggaccagtggacctaccagatctaccaggagcccttcaagaacctgaagaccggcaagtacgcccgcaagcgctccgcccacaccaacgacgtgcgccagctgaccgaggtggtgcagaagatcgccaccgagtccatcgtgatctggggcaagacccccaagttccgcctgcccatccagcgcgagacctgggagacctggtggatggagtactggcaggccacctggatccccgagtgggagttcgtgaacaccccccccctggtgaagctgtggtaccagctggagaaggaccccatcgtgggcgccgagaccttctacgtggacggcgccgcctcccgcgagaccaagctgggcaaggccggctacgtgaccgaccgcggccgccagaaggtggtgtccctgaccgagaccaccaaccagaagaccgagctgcacgccatccacctggccctgcaggactccggctccgaggtgaacatcgtgaccgactcccagtacgccctgggcatcatccaggcccagcccgaccgctccgagtccgaggtggtgaaccagatcatcgaggagctgatcaagaaggagaaggtgtacctgtcctgggtgcccgcccacaagggcatcggcggcaacgagcaggtggacaagctggtgtcctccggcatccgcaaggtgctgttcctggacggcatcgacaaggcccaggaggagcacgagcgctaccactccaactggcgcaccatggcctccgacttcaacctgccccccatcgtggccaaggagatcgtggccaactgcgacaagtgccagctgaagggcgaggccatgcacggccaggtggactgctcccccggcatctggcagctggactgcacccacctggagggcaaggtgatcctggtggccgtgcacgtggcctccggctacatcgaggccgaggtgatccccgccgagaccggccaggagaccgcctacttcctgctgaagctggccggccgctggcccgtgaaggtgatccacaccgacaacggctccaacttcacctccgccgccgtgaaggccgcctgctggtgggccaacgtgcgccaggagttcggcatcccctacaacccccagtcccagggcgtggtggagtccatgaacaaggagctgaagaagatcatcggccaggtgcgcgagcaggccgagcacctgaagaccgccgtgcagatggccgtgttcatccacaacttcaagcgcaagggcggcatcggcggctactccgccggcgagcgcatcatcgacatcatcgccaccgacatccagaccaaggagctgcagaagcagatcaccaagatccagaacttccgcgtgtactaccgcgactcccgcgaccccatctggaagggccccgccaagctgctgtggaagggcgagggcgccgtggtgatccaggacaactccgacatcaaggtggtgccccgccgcaaggccaagatcatccgcgactacggcaagcagatggccggcgacgactgcgtggccggccgccaggacgaggactaa

SEQ ID NO: 244 - protein, 1003 aa, Human immunodeficiency virus
FFRENLAFQQGEARKFSSEQTGTNSPTSRELWDGGRDNLLSEAGTEGQGTISSFNFPQITLWQRPLVTVRIGGQLIEALLDTGADDTVLEEINLPGKWKPKMIGGIGGFIKVRQYDQILIEICGKKAIGTVLVGPTPVNIIGRNMLTQIGCTLNFPISPIETVPVKLKPGMDGPKVKQWPLTEEKIKALTDICTEMEKEGKISKIGPENPYNTPVFAIKKKDSTKWRKLVDFRELNKRTQDFWEVQLGIPHPAGLKKKKSVTVLDVGDAYFSVPLDKDFRKYTAFTIPSVNNETPGIRYQYNVLPQGWKGSPAIFQASMTKILEPFRTKNPEIVIYQYMDDLYVGSDLEIGQHRAKIEELREHLLRWGFTTPDKKHQKEPPFLWMGYELHPDKWTVQPIQLPEKDSWTVNDIQKLVGKLNWASQIYAGIKVKQLCKLLRGAKALTDIVTLTEEAELELAENREILKEPVHGVYYDPTKDLIAEIQKQGQDQWTYQIYQEPFKNLKTGKYAKMRSAHTNDVKQLTEVVQKVATESIVIWGKTPKFRLPIQRETWEAWWMEYWQATWIPEWEFVNTPPLVKLWYQLEKDPIVGAETFYVDGAANRETKLGKAGYVTDRGRQKVVSLTETTNQKTELHAIHLALQDSGSEVNIVTDSQYALGIIQAQPDRSESELVNQIIEKLIEKDKVYLSWVPAHKGIGGNEQVDKLVSNGIRKVLFLDGIDKAQEEHERYHSNWRAMASDFNLPPIVAKEIVASCDKCQLKGEAMHGQVDCSPGIWQLDCTHLEGKIILVAVHVASGYIEAEVIPAETGQETAYFILKLAGRWPVKVIHTDNGSNFTSAAVKAACWWANVTQEFGIPYNPQSQGVVESMNKELKKIIGQVRDQAEHLKTAVQMAVFIHNFKRKGGIGGYSAGERIIDIIASDIQTKELQKQITKIQNFRVYYRDSRDPIWKGPAKLLWKGEGAVVIQDNSDIKVVPRRKAKIIRDYGKQMAGDDCVAGRQDED

SEQ ID NO: 245 - protein, 1003 aa, Human immunodeficiency virus
FFRENLAFQQREARKFSSEQTRAISPTSRKLWDGGRDNPLPETGTERQGTASSFNFPQITLWQRPLVTVRIGGQLKEALLDTGADDTVLEDINLPGKWKPKMIGGIGGFIKVRQYDQILIEICGKKAIGTVLVGPTPVNIIGRNMLTQLGCTLNFPISPIETVPVTLKPGMDGPKVKQWPLTEEKIKALTDICKEMEKEGKISKIGPENPYNTPVFAIKKKDSTKWRKLVDFRELNKRTQDFWEVQLGIPHPAGLKKKKSVTVLDVGDAYFSVPLDQDFRKYTAFTIPSTNNETPGIRYQYNVLPQGWKGSPAIFQSSMTKILEPFRKQNPEIVIYQYMDDLYVGSDLEIGQHRTKIEELREHLLRWGFTTPDKKHQKEPPFLWMGYELHPDKWTVQPIVLPEKDSWTVNDIQKLVGKLNWASQIYAGIKVRQLCKLLRGAKALTEVIPLTAEAELELAENREILKEPVHGVYYDPSKDLVAEIQKQGQGQWTYQIYQEPFKNLKTGKYARLRGAHTNDVKQLTEAVQKIATESIVIWGKTPKFKLPIQKETWETWWTEYWQATWIPEWEFVNTPPLVKLWYQLEKEPIVGAETFYVDGAANRETKSGKAGYVTDRGRQKVVSLTDTTNQKTELQAIHLALQDSGLEVNIVTDSQYALGIIQAQPDKSESELVSQIIEQLIKKEKVYLAWVPAHKGIGGNEQVDKLVSAGIRKVLFLDGIDKAQEAHEKYHSNWRAMASDFNLPPVVAKEIVASCDKCQLKGEAMHGQVDCSPGIWQLDCTHLEGKIILVAVHVASGYIEAEVIPAETGQETAYFVLKLAGRWPVKIIHTDNGSNFISTAVKAACWWAGIKQEFGIPYNPQSQGVVESMNKQLKQIIGQVRDQAEHLKTAVQMAVFIHNFKRKGGIGGYSAGERIIDIIATDIQTKELQKQIIKIQNFRVYYRDSRDPIWKGPAKLLWKGEGAVVIQDNNDIKVVPRRKAKIIRDYGKQMAGDDCVASRQDED

SEQ ID NO: 246 - DNA, 3012 bp, Human immunodeficiency virus
ttcttccgcgagaacctggccttccagcagggcgaggcccgcaagttctcctccgagcagaccggcaccaactcccccacctcccgcgagctgtgggacggcggccgcgacaacctgctgtccgaggccggcaccgagggccagggcaccatctcctccttcaacttcccccagatcaccctgtggcagcgccccctggtgaccgtgcgcatcggcggccagctgatcgaggccctgctggacaccggcgccgacgacaccgtgctggaggagatcaacctgcccggcaagtggaagcccaagatgatcggcggcatcggcggcttcatcaaggtgcgccagtacgaccagatcctgatcgagatctgcggcaagaaggccatcggcaccgtgctggtgggccccacccccgtgaacatcatcggccgcaacatgctgacccagatcggctgcaccctgaacttccccatctcccccatcgagaccgtgcccgtgaagctgaagcccggcatggacggccccaaggtgaagcagtggcccctgaccgaggagaagatcaaggccctgaccgacatctgcaccgagatggagaaggagggcaagatctccaagatcggccccgagaacccctacaacacccccgtgttcgccatcaagaagaaggactccaccaagtggcgcaagctggtggacttccgcgagctgaacaagcgcacccaggacttctgggaggtgcagctgggcatcccccaccccgccggcctgaagaagaagaagtccgtgaccgtgctggacgtgggcgacgcctacttctccgtgcccctggacaaggacttccgcaagtacaccgccttcaccatcccctccgtgaacaacgagacccccggcatccgctaccagtacaacgtgctgccccagggctggaagggctcccccgccatcttccaggcctccatgaccaagatcctggagcccttccgcaccaagaaccccgagatcgtgatctaccagtacatggacgacctgtacgtgggctccgacctggagatcggccagcaccgcgccaagatcgaggagctgcgcgagcacctgctgcgctggggcttcaccacccccgacaagaagcaccagaaggagccccccttcctgtggatgggctacgagctgcaccccgacaagtggaccgtgcagcccatccagctgcccgagaaggactcctggaccgtgaacgacatccagaagctggtgggcaagctgaactgggcctcccagatctacgccggcatcaaggtgaagcagctgtgcaagctgctgcgcggcgccaaggccctgaccgacatcgtgaccctgaccgaggaggccgagctggagctggccgagaaccgcgagatcctgaaggagcccgtgcacggcgtgtactacgaccccaccaaggacctgatcgccgagatccagaagcagggccaggaccagtggacctaccagatctaccaggagcccttcaagaacctgaagaccggcaagtacgccaagatgcgctccgcccacaccaacgacgtgaagcagctgaccgaggtggtgcagaaggtggccaccgagtccatcgtgatctggggcaagacccccaagttccgcctgcccatccagcgcgagacctgggaggcctggtggatggagtactggcaggccacctggatccccgagtgggagttcgtgaacaccccccccctggtgaagctgtggtaccagctggagaaggaccccatcgtgggcgccgagaccttctacgtggacggcgccgccaaccgcgagaccaagctgggcaaggccggctacgtgaccgaccgcggccgccagaaggtggtgtccctgaccgagaccaccaaccagaagaccgagctgcacgccatccacctggccctgcaggactccggctccgaggtgaacatcgtgaccgactcccagtacgccctgggcatcatccaggcccagcccgaccgctccgagtccgagctggtgaaccagatcatcgagaagctgatcgagaaggacaaggtgtacctgtcctgggtgcccgcccacaagggcatcggcggcaacgagcaggtggacaagctggtgtccaacggcatccgcaaggtgctgttcctggacggcatcgacaaggcccaggaggagcacgagcgctaccactccaactggcgcgccatggcctccgacttcaacctgccccccatcgtggccaaggagatcgtggcctcctgcgacaagtgccagctgaagggcgaggccatgcacggccaggtggactgctcccccggcatctggcagctggactgcacccacctggagggcaagatcatcctggtggccgtgcacgtggcctccggctacatcgaggccgaggtgatccccgccgagaccggccaggagaccgcctacttcatcctgaagctggccggccgctggcccgtgaaggtgatccacaccgacaacggctccaacttcacctccgccgccgtgaaggccgcctgctggtgggccaacgtgacccaggagttcggcatcccctacaacccccagtcccagggcgtggtggagtccatgaacaaggagctgaagaagatcatcggccaggtgcgcgaccaggccgagcacctgaagaccgccgtgcagatggccgtgttcatccacaacttcaagcgcaagggcggcatcggcggctactccgccggcgagcgcatcatcgacatcatcgcctccgacatccagaccaaggagctgcagaagcagatcaccaagatccagaacttccgcgtgtactaccgcgactcccgcgaccccatctggaagggccccgccaagctgctgtggaagggcgagggcgccgtggtgatccaggacaactccgacatcaaggtggtgccccgccgcaaggccaagatcatccgcgactacggcaagcagatggccggcgacgactgcgtggccggccgccaggacgaggactaa

SEQ ID NO: 247 - DNA, 3012 bp, Human immunodeficiency virus
ttcttccgcgagaacctggccttccagcagcgcgaggcccgcaagttctcctccgagcagacccgcgccatctcccccacctcccgcaagctgtgggacggcggccgcgacaaccccctgcccgagaccggcaccgagcgccagggcaccgcctcctccttcaacttcccccagatcaccctgtggcagcgccccctggtgaccgtgcgcatcggcggccagctgaaggaggccctgctggacaccggcgccgacgacaccgtgctggaggacatcaacctgcccggcaagtggaagcccaagatgatcggcggcatcggcggcttcatcaaggtgcgccagtacgaccagatcctgatcgagatctgcggcaagaaggccatcggcaccgtgctggtgggccccacccccgtgaacatcatcggccgcaacatgctgacccagctgggctgcaccctgaacttccccatctcccccatcgagaccgtgcccgtgaccctgaagcccggcatggacggccccaaggtgaagcagtggcccctgaccgaggagaagatcaaggccctgaccgacatctgcaaggagatggagaaggagggcaagatctccaagatcggccccgagaacccctacaacacccccgtgttcgccatcaagaagaaggactccaccaagtggcgcaagctggtggacttccgcgagctgaacaagcgcacccaggacttctgggaggtgcagctgggcatcccccaccccgccggcctgaagaagaagaagtccgtgaccgtgctggacgtgggcgacgcctacttctccgtgcccctggaccaggacttccgcaagtacaccgccttcaccatcccctccaccaacaacgagacccccggcatccgctaccagtacaacgtgctgccccagggctggaagggctcccccgccatcttccagtcctccatgaccaagatcctggagcccttccgcaagcagaaccccgagatcgtgatctaccagtacatggacgacctgtacgtgggctccgacctggagatcggccagcaccgcaccaagatcgaggagctgcgcgagcacctgctgcgctggggcttcaccacccccgacaagaagcaccagaaggagccccccttcctgtggatgggctacgagctgcaccccgacaagtggaccgtgcagcccatcgtgctgcccgagaaggactcctggaccgtgaacgacatccagaagctggtgggcaagctgaactgggcctcccagatctacgccggcatcaaggtgcgccagctgtgcaagctgctgcgcggcgccaaggccctgaccgaggtgatccccctgaccgccgaggccgagctggagctggccgagaaccgcgagatcctgaaggagcccgtgcacggcgtgtactacgacccctccaaggacctggtggccgagatccagaagcagggccagggccagtggacctaccagatctaccaggagcccttcaagaacctgaagaccggcaagtacgcccgcctgcgcggcgcccacaccaacgacgtgaagcagctgaccgaggccgtgcagaagatcgccaccgagtccatcgtgatctggggcaagacccccaagttcaagctgcccatccagaaggagacctgggagacctggtggaccgagtactggcaggccacctggatccccgagtgggagttcgtgaacaccccccccctggtgaagctgtggtaccagctggagaaggagcccatcgtgggcgccgagaccttctacgtggacggcgccgccaaccgcgagaccaagtccggcaaggccggctacgtgaccgaccgcggccgccagaaggtggtgtccctgaccgacaccaccaaccagaagaccgagctgcaggccatccacctggccctgcaggactccggcctggaggtgaacatcgtgaccgactcccagtacgccctgggcatcatccaggcccagcccgacaagtccgagtccgagctggtgtcccagatcatcgagcagctgatcaagaaggagaaggtgtacctggcctgggtgcccgcccacaagggcatcggcggcaacgagcaggtggacaagctggtgtccgccggcatccgcaaggtgctgttcctggacggcatcgacaaggcccaggaggcccacgagaagtaccactccaactggcgcgccatggcctccgacttcaacctgccccccgtggtggccaaggagatcgtggcctcctgcgacaagtgccagctgaagggcgaggccatgcacggccaggtggactgctcccccggcatctggcagctggactgcacccacctggagggcaagatcatcctggtggccgtgcacgtggcctccggctacatcgaggccgaggtgatccccgccgagaccggccaggagaccgcctacttcgtgctgaagctggccggccgctggcccgtgaagatcatccacaccgacaacggctccaacttcatctccaccgccgtgaaggccgcctgctggtgggccggcatcaagcaggagttcggcatcccctacaacccccagtcccagggcgtggtggagtccatgaacaagcagctgaagcagatcatcggccaggtgcgcgaccaggccgagcacctgaagaccgccgtgcagatggccgtgttcatccacaacttcaagcgcaagggcggcatcggcggctactccgccggcgagcgcatcatcgacatcatcgccaccgacatccagaccaaggagctgcagaagcagatcatcaagatccagaacttccgcgtgtactaccgcgactcccgcgaccccatctggaagggccccgccaagctgctgtggaagggcgagggcgccgtggtgatccaggacaacaacgacatcaaggtggtgccccgccgcaaggccaagatcatccgcgactacggcaagcagatggccggcgacgactgcgtggcctcccgccaggacgaggactaa

SEQ ID NO: 248 - protein, 1002 aa, Human immunodeficiency virus
FFRENVAFQQREARKFSSEQARANSPARRELRDERGDNLLSEAGTEGQGTISFNFPQITLWQRPLVTIKIGGQIREALLDTGADDTVLEEINLPGKWKPKMIGGIGGFIKVRQYDQIPIEICGKKAIGTVLVGPTPVNIIGRNMLTQLGCTLNFPISPIETVPVKLKPGMDGPKVKQWPLTEEKIKALTEICTEMEKEGKISKIGPENPYNTPIFAIKKKNSTRWRKLVDFRELNKRTQDFWEVQLGIPHPAGLKKKKSVTVLDVGDAYFSVPLDPEFRKYTAFTIPSTNNETPGIRYQYNVLPQGWKGSPAIFQCSMTKILEPFRTKNPEIVIYQYMDDLYVGSDLEIGQHRAKIEELREHLLRWGFSTPDKKHQKEPPFLWMGYELHPDKWTVQPIQLAEKDSWTVNDIQKLVGKLNWASQIYPGIKVKQLCKLLRGAKALTDIVPLTTEAELELAENREILKEPVHGAYYDPSKDLIAEIQKQGQGQWTYQIYQEPYKNLKTGKYAKTRSAHTNDVRQLTEAVQKIAMECIVIWGKTPKFRLPIQKETWDTWWTEYWQATWIPEWEFVNTPPLVKLWYQLETDPIAGAETFYVDGAASRETKQGKAGYVTDRGRQKVVSLSETTNQKTELQAIYLALQDSGSEVNIVTDSQYAIGIIQAQPDRSESDLVNQIIEQLIQKDKVYLSWVPAHKGIGGNEQVDKLVSNGIRKVLFLDGIDKAQEEHEKYHNNWRAMASDFNLPPVVAKEIVASCNKCQLKGEAMHGQVDCSPGIWQLDCTHLEGKIILVAVHVASGYIEAEVIPAETGQETAYFILKLAGRWPVKIIHTDNGPNFTSAAVKAACWWADIQQEFGIPYNPQSQGVVESMNKELKKIIGQVRDQAEHLKTAVQMAVFIHNFKRKGGIGGYSAGERIIDIIASDIQTKELQKQITKIQNFRVYYRDSRDPIWKGPAKLLWKGEGAVVIQDNSDIKVVPRRKAKIIRDYGKQMAGDDCVAGRQDED

SEQ ID NO: 249 - protein, 1002 aa, Human immunodeficiency virus
FFRENLAFQQGEAREFSSEQARANSPTRRELRVRRGDSPLPEAGAEGQGAISLSFPQITLWQRPLVTVRIGGQLIEALLDTGADDTVLEDINLPGKWKPKMIGGIGGFIKVRQYDQILIEICGKKAIGTVLVGPTPVNIIGRNMLTQIGCTLNFPISPIETVPVKLKPGMDGPKVKQWPLTEEKIKALTEICTEMEKEGKISKIGPENPYNTPIFAIKKKDSTKWRKLVDFRELNKRTQDFWEVQLGIPHPAGLKKKKSVTVLDVGDAYFSVPLDEDFRKYTAFTIPSINNETPGIRYQYNVLPQGWKGSPAIFQSSMIKILEPFRIKNPEIVIYQYMDDLYVGSDLEIGQHRAKIEELREHLLKWGFTTPDKKHQKEPPFLWMGYELHPDKWTVQPIQLPDKDSWTVNDIQKLVGKLNWASQIYPGIKVKQLCKLLRGAKALTDIVPLTAEAELELAENREILKEPVHGVYYDPSKDLIAEIQKQGQGQWTYQIYQEPHKNLKTGKYARIKSAHTNDVKQLTEAVQKIALESIVIWGKTPKFRLPIQKETWETWWTEYWQATWIPEWEFVNTPPLVKLWYQLETEPIVGAETFYVDGAANRETKKGKAGYVTDRGRQKVVSLTETTNQKTELQAINLALQDSGSEVNIVTDSQYALGIIQAQPDKSESELVNQIIEQLIKKEKVYLSWVPAHKGIGGNEQVDKLVSTGIRKVLFLDGIDKAQEDHERYHSNWRAMASDFNLPPIVAKEIVASCDKCQLKGEAMHGQVDCSPGIWQLDCTHLEGKIILVAVHVASGYIEAEVIPAETGQETAYFILKLAGRWPVKVIHTDNGSNFTSAAVKAACWWANITQEFGIPYNPQSQGVVESMNKELKKIIGQVRDQAEHLKTAVQMAVFIHNFKRKGGIGGYSAGERIIDIIASDIQTKELQKQITKIQNFRVYYRDSRDPIWKGPAKLLWKGEGAVVIQDNSEIKVVPRRKAKIIRDYGKQMAGDDCVAGRQDED

SEQ ID NO: 250 - DNA, 3009 bp, Human immunodeficiency virus
ttcttccgcgagaacgtggccttccagcagcgcgaggcccgcaagttctcctccgagcaggcccgcgccaactcccccgcccgccgcgagctgcgcgacgagcgcggcgacaacctgctgtccgaggccggcaccgagggccagggcaccatctccttcaacttcccccagatcaccctgtggcagcgccccctggtgaccatcaagatcggcggccagatccgcgaggccctgctggacaccggcgccgacgacaccgtgctggaggagatcaacctgcccggcaagtggaagcccaagatgatcggcggcatcggcggcttcatcaaggtgcgccagtacgaccagatccccatcgagatctgcggcaagaaggccatcggcaccgtgctggtgggccccacccccgtgaacatcatcggccgcaacatgctgacccagctgggctgcaccctgaacttccccatctcccccatcgagaccgtgcccgtgaagctgaagcccggcatggacggccccaaggtgaagcagtggcccctgaccgaggagaagatcaaggccctgaccgagatctgcaccgagatggagaaggagggcaagatctccaagatcggccccgagaacccctacaacacccccatcttcgccatcaagaagaagaactccacccgctggcgcaagctggtggacttccgcgagctgaacaagcgcacccaggacttctgggaggtgcagctgggcatcccccaccccgccggcctgaagaagaagaagtccgtgaccgtgctggacgtgggcgacgcctacttctccgtgcccctggaccccgagttccgcaagtacaccgccttcaccatcccctccaccaacaacgagacccccggcatccgctaccagtacaacgtgctgccccagggctggaagggctcccccgccatcttccagtgctccatgaccaagatcctggagcccttccgcaccaagaaccccgagatcgtgatctaccagtacatggacgacctgtacgtgggctccgacctggagatcggccagcaccgcgccaagatcgaggagctgcgcgagcacctgctgcgctggggcttctccacccccgacaagaagcaccagaaggagccccccttcctgtggatgggctacgagctgcaccccgacaagtggaccgtgcagcccatccagctggccgagaaggactcctggaccgtgaacgacatccagaagctggtgggcaagctgaactgggcctcccagatctaccccggcatcaaggtgaagcagctgtgcaagctgctgcgcggcgccaaggccctgaccgacatcgtgcccctgaccaccgaggccgagctggagctggccgagaaccgcgagatcctgaaggagcccgtgcacggcgcctactacgacccctccaaggacctgatcgccgagatccagaagcagggccagggccagtggacctaccagatctaccaggagccctacaagaacctgaagaccggcaagtacgccaagacccgctccgcccacaccaacgacgtgcgccagctgaccgaggccgtgcagaagatcgccatggagtgcatcgtgatctggggcaagacccccaagttccgcctgcccatccagaaggagacctgggacacctggtggaccgagtactggcaggccacctggatccccgagtgggagttcgtgaacaccccccccctggtgaagctgtggtaccagctggagaccgaccccatcgccggcgccgagaccttctacgtggacggcgccgcctcccgcgagaccaagcagggcaaggccggctacgtgaccgaccgcggccgccagaaggtggtgtccctgtccgagaccaccaaccagaagaccgagctgcaggccatctacctggccctgcaggactccggctccgaggtgaacatcgtgaccgactcccagtacgccatcggcatcatccaggcccagcccgaccgctccgagtccgacctggtgaaccagatcatcgagcagctgatccagaaggacaaggtgtacctgtcctgggtgcccgcccacaagggcatcggcggcaacgagcaggtggacaagctggtgtccaacggcatccgcaaggtgctgttcctggacggcatcgacaaggcccaggaggagcacgagaagtaccacaacaactggcgcgccatggcctccgacttcaacctgccccccgtggtggccaaggagatcgtggcctcctgcaacaagtgccagctgaagggcgaggccatgcacggccaggtggactgctcccccggcatctggcagctggactgcacccacctggagggcaagatcatcctggtggccgtgcacgtggcctccggctacatcgaggccgaggtgatccccgccgagaccggccaggagaccgcctacttcatcctgaagctggccggccgctggcccgtgaagatcatccacaccgacaacggccccaacttcacctccgccgccgtgaaggccgcctgctggtgggccgacatccagcaggagttcggcatcccctacaacccccagtcccagggcgtggtggagtccatgaacaaggagctgaagaagatcatcggccaggtgcgcgaccaggccgagcacctgaagaccgccgtgcagatggccgtgttcatccacaacttcaagcgcaagggcggcatcggcggctactccgccggcgagcgcatcatcgacatcatcgcctccgacatccagaccaaggagctgcagaagcagatcaccaagatccagaacttccgcgtgtactaccgcgactcccgcgaccccatctggaagggccccgccaagctgctgtggaagggcgagggcgccgtggtgatccaggacaactccgacatcaaggtggtgccccgccgcaaggccaagatcatccgcgactacggcaagcagatggccggcgacgactgcgtggccggccgccaggacgaggactaa

SEQ ID NO: 251 - DNA, 3009 bp, Human immunodeficiency virus
ttcttccgcgagaacctggccttccagcagggcgaggcccgcgagttctcctccgagcaggcccgcgccaactcccccacccgccgcgagctgcgcgtgcgccgcggcgactcccccctgcccgaggccggcgccgagggccagggcgccatctccctgtccttcccccagatcaccctgtggcagcgccccctggtgaccgtgcgcatcggcggccagctgatcgaggccctgctggacaccggcgccgacgacaccgtgctggaggacatcaacctgcccggcaagtggaagcccaagatgatcggcggcatcggcggcttcatcaaggtgcgccagtacgaccagatcctgatcgagatctgcggcaagaaggccatcggcaccgtgctggtgggccccacccccgtgaacatcatcggccgcaacatgctgacccagatcggctgcaccctgaacttccccatctcccccatcgagaccgtgcccgtgaagctgaagcccggcatggacggccccaaggtgaagcagtggcccctgaccgaggagaagatcaaggccctgaccgagatctgcaccgagatggagaaggagggcaagatctccaagatcggccccgagaacccctacaacacccccatcttcgccatcaagaagaaggactccaccaagtggcgcaagctggtggacttccgcgagctgaacaagcgcacccaggacttctgggaggtgcagctgggcatcccccaccccgccggcctgaagaagaagaagtccgtgaccgtgctggacgtgggcgacgcctacttctccgtgcccctggacgaggacttccgcaagtacaccgccttcaccatcccctccatcaacaacgagacccccggcatccgctaccagtacaacgtgctgccccagggctggaagggctcccccgccatcttccagtcctccatgatcaagatcctggagcccttccgcatcaagaaccccgagatcgtgatctaccagtacatggacgacctgtacgtgggctccgacctggagatcggccagcaccgcgccaagatcgaggagctgcgcgagcacctgctgaagtggggcttcaccacccccgacaagaagcaccagaaggagccccccttcctgtggatgggctacgagctgcaccccgacaagtggaccgtgcagcccatccagctgcccgacaaggactcctggaccgtgaacgacatccagaagctggtgggcaagctgaactgggcctcccagatctaccccggcatcaaggtgaagcagctgtgcaagctgctgcgcggcgccaaggccctgaccgacatcgtgcccctgaccgccgaggccgagctggagctggccgagaaccgcgagatcctgaaggagcccgtgcacggcgtgtactacgacccctccaaggacctgatcgccgagatccagaagcagggccagggccagtggacctaccagatctaccaggagccccacaagaacctgaagaccggcaagtacgcccgcatcaagtccgcccacaccaacgacgtgaagcagctgaccgaggccgtgcagaagatcgccctggagtccatcgtgatctggggcaagacccccaagttccgcctgcccatccagaaggagacctgggagacctggtggaccgagtactggcaggccacctggatccccgagtgggagttcgtgaacaccccccccctggtgaagctgtggtaccagctggagaccgagcccatcgtgggcgccgagaccttctacgtggacggcgccgccaaccgcgagaccaagaagggcaaggccggctacgtgaccgaccgcggccgccagaaggtggtgtccctgaccgagaccaccaaccagaagaccgagctgcaggccatcaacctggccctgcaggactccggctccgaggtgaacatcgtgaccgactcccagtacgccctgggcatcatccaggcccagcccgacaagtccgagtccgagctggtgaaccagatcatcgagcagctgatcaagaaggagaaggtgtacctgtcctgggtgcccgcccacaagggcatcggcggcaacgagcaggtggacaagctggtgtccaccggcatccgcaaggtgctgttcctggacggcatcgacaaggcccaggaggaccacgagcgctaccactccaactggcgcgccatggcctccgacttcaacctgccccccatcgtggccaaggagatcgtggcctcctgcgacaagtgccagctgaagggcgaggccatgcacggccaggtggactgctcccccggcatctggcagctggactgcacccacctggagggcaagatcatcctggtggccgtgcacgtggcctccggctacatcgaggccgaggtgatccccgccgagaccggccaggagaccgcctacttcatcctgaagctggccggccgctggcccgtgaaggtgatccacaccgacaacggctccaacttcacctccgccgccgtgaaggccgcctgctggtgggccaacatcacccaggagttcggcatcccctacaacccccagtcccagggcgtggtggagtccatgaacaaggagctgaagaagatcatcggccaggtgcgcgaccaggccgagcacctgaagaccgccgtgcagatggccgtgttcatccacaacttcaagcgcaagggcggcatcggcggctactccgccggcgagcgcatcatcgacatcatcgcctccgacatccagaccaaggagctgcagaagcagatcaccaagatccagaacttccgcgtgtactaccgcgactcccgcgaccccatctggaagggccccgccaagctgctgtggaagggcgagggcgccgtggtgatccaggacaactccgagatcaaggtggtgccccgccgcaaggccaagatcatccgcgactacggcaagcagatggccggcgacgactgcgtggccggccgccaggacgaggactaa

SEQ ID NO: 252 - protein, 999 aa, Human immunodeficiency virus
FFREILAFPQGEAREFPPEQTRANSPTSRELQVRGDNPSSEAGTERQGTLNFPQITLWQRPLVSIKVGGQIKEALLDTGADDTVLEEVNLPGKWKPKMIGGIGGFIKVRQYEQIPIEICGKKAIGTVLVGPTPVNIIGRNMLTQLGCTLNFPISPIETVPVKLKPGMDGPKVKQWPLTEEKIKALTAICDEMEKEGKITKIGPDNPYNTPIFAIRKKDSSKWRKLVDFRELNKRTQDFWEVQLGIPHPAGLKKKKSVTVLDVGDAYFSVPLDKDFRKYTAFTIPSVNNETPGIRYQYNVLPQGWKGSPAIFQCSMTKILEPFRKQNPDIVIYQYMDDLYVGSDLEIGQHRTKIEELREHLLKWGFTTPDKKHQKEPPFLWMGYELHPDKWTVQPIQLPEKDSWTVNDIQKLVGKLNWASQIYPGIKVRQLCKLLRGAKALTDIVPLTEEAELELAENREILKEPVHGAYYDPSKELIAEIQKQGQDQWTYQIYQEPFKNLKTGKYAKMRTAHTNDVKQLTEAVQKIAMESIVIWGKIPKFRLPIQKETWETWWTDYWQATWIPEWEFVNTPPLVKLWYQLEKDPIAGVETFYVDGAANRETKIGKAGYVTDRGRKKIVSLTDTTNQKTELQAIYIALQDSGSEVNIVTDSQYALGIIQAQPDKSESELVNQIIEQLIKKERVYLSWVPAHKGIGGNEQVDKLVSNGIRKVLFLDGIDKAQEEHEKYHSNWRAMASDFNLPPIVAKEIVASCDQCQLKGEAMHGQVDCSPGIWQLDCTHLEGKIILVAVHVASGYIEAEVIPAETGQETAYFILKLAGRWPVKVIHTDNGSNFTSAAVKAACWWAGIQQEFGIPYNPQSQGVVESMNKELKKLIGQVRDQAEHLKTAVQMAVFIHNFKRKGGIGGYSAGERIVDIIATDIQTRELQKQIIKIQNFRVYYRDSRDPIWKGPAKLLWKGEGAVVIQDNSDIKVVPRRKAKIIKDYGKQMAGADCVAGRQDED

SEQ ID NO: 253 - protein, 1003 aa, Human immunodeficiency virus
FFRENLAFQQRKARELPSEQTRANSPTSRELRVWGGDNTLSETGAERQGAVSLSFPQITLWQRPLVTVKIGGQLKEALLDTGADDTVLEEMNLPGKWKPKMIGGIGGFIKVRQYDQILIEICGYKAIGTVLVGPTPVNIIGRNLLTQIGCTLNFPISPIETVPVKLKPGMDGPKVKQWPLTEEKIKALTEICTEMEKEGKISRIGPENPYNTPIFAIKKKDSTKWRKLVDFRELNKRTQDFWEVQLGIPHPAGLKKKKSVTVLDVGDAYFSVPLYEDFRKYTAFTIPSINNETPGIRYQYNVLPQGWKGSPAIFQSSMTKILEPFRKQNPEMVIYQYMDDLYVGSDLEIGQHRIKIEELRGHLLKWGFTTPDKKHQKEPPFLWMGYELHPDKWTVQPIQLPEKDSWTVNDIQKLVGKLNWASQIYPGIKVRQLCKLLRGAKALTDIVPLTEEAELELAENREILKEPVHGVYYDPSKDLIAEIQKQGQDQWTYQIYQEPHKNLKTGKYAKRRTAHTNDVKQLTEAVQKIAQESIVIWGKTPKFRLPIQKETWETWWTDYWQATWIPEWEFVNTPPLVKLWYQLEKEPIVGAETFYVDGAANRETKLGKAGYVTDRGRQKVISITDTTNQKTELQAINLALQDSGSEVNIVTDSQYALGIIQAQPDKSESELVNQIIEQLIKKEKVYLSWVPAHKGIGGNEQVDKLVSSGIRKVLFLDGIDKAQEEHEKYHNNWRAMASDFNLPPVVAKEIVASCDKCQLKGEALHGQVDCSPGIWQLDCTHLEGKVILVAVHVASGYIEAEVIPAETGQETAYFLLKLAGRWPVKVVHTDNGSNFTSAAVKAACWWAGIKQEFGIPYNPQSQGVVESMNKELKKIIGQVRDQAEHLKTAVQMAVFIHNFKRKGGIGGYSAGERIIDIIATDIQTKELQKQIIKIQNFRVYYRDSRDPIWKGPAKLLWKGEGAVVIQDNSDIKVVPRRKVKIIKDYGKQMAGADCVASRQDEDQ

SEQ ID NO: 254 - DNA, 3000 bp, Human immunodeficiency virus
ttcttccgcgagatcctggccttcccccagggcgaggcccgcgagttcccccccgagcagacccgcgccaactcccccacctcccgcgagctgcaggtgcgcggcgacaacccctcctccgaggccggcaccgagcgccagggcaccctgaacttcccccagatcaccctgtggcagcgccccctggtgtccatcaaggtgggcggccagatcaaggaggccctgctggacaccggcgccgacgacaccgtgctggaggaggtgaacctgcccggcaagtggaagcccaagatgatcggcggcatcggcggcttcatcaaggtgcgccagtacgagcagatccccatcgagatctgcggcaagaaggccatcggcaccgtgctggtgggccccacccccgtgaacatcatcggccgcaacatgctgacccagctgggctgcaccctgaacttccccatctcccccatcgagaccgtgcccgtgaagctgaagcccggcatggacggccccaaggtgaagcagtggcccctgaccgaggagaagatcaaggccctgaccgccatctgcgacgagatggagaaggagggcaagatcaccaagatcggccccgacaacccctacaacacccccatcttcgccatccgcaagaaggactcctccaagtggcgcaagctggtggacttccgcgagctgaacaagcgcacccaggacttctgggaggtgcagctgggcatcccccaccccgccggcctgaagaagaagaagtccgtgaccgtgctggacgtgggcgacgcctacttctccgtgcccctggacaaggacttccgcaagtacaccgccttcaccatcccctccgtgaacaacgagacccccggcatccgctaccagtacaacgtgctgccccagggctggaagggctcccccgccatcttccagtgctccatgaccaagatcctggagcccttccgcaagcagaaccccgacatcgtgatctaccagtacatggacgacctgtacgtgggctccgacctggagatcggccagcaccgcaccaagatcgaggagctgcgcgagcacctgctgaagtggggcttcaccacccccgacaagaagcaccagaaggagccccccttcctgtggatgggctacgagctgcaccccgacaagtggaccgtgcagcccatccagctgcccgagaaggactcctggaccgtgaacgacatccagaagctggtgggcaagctgaactgggcctcccagatctaccccggcatcaaggtgcgccagctgtgcaagctgctgcgcggcgccaaggccctgaccgacatcgtgcccctgaccgaggaggccgagctggagctggccgagaaccgcgagatcctgaaggagcccgtgcacggcgcctactacgacccctccaaggagctgatcgccgagatccagaagcagggccaggaccagtggacctaccagatctaccaggagcccttcaagaacctgaagaccggcaagtacgccaagatgcgcaccgcccacaccaacgacgtgaagcagctgaccgaggccgtgcagaagatcgccatggagtccatcgtgatctggggcaagatccccaagttccgcctgcccatccagaaggagacctgggagacctggtggaccgactactggcaggccacctggatccccgagtgggagttcgtgaacaccccccccctggtgaagctgtggtaccagctggagaaggaccccatcgccggcgtggagaccttctacgtggacggcgccgccaaccgcgagaccaagatcggcaaggccggctacgtgaccgaccgcggccgcaagaagatcgtgtccctgaccgacaccaccaaccagaagaccgagctgcaggccatctacatcgccctgcaggactccggctccgaggtgaacatcgtgaccgactcccagtacgccctgggcatcatccaggcccagcccgacaagtccgagtccgagctggtgaaccagatcatcgagcagctgatcaagaaggagcgcgtgtacctgtcctgggtgcccgcccacaagggcatcggcggcaacgagcaggtggacaagctggtgtccaacggcatccgcaaggtgctgttcctggacggcatcgacaaggcccaggaggagcacgagaagtaccactccaactggcgcgccatggcctccgacttcaacctgccccccatcgtggccaaggagatcgtggcctcctgcgaccagtgccagctgaagggcgaggccatgcacggccaggtggactgctcccccggcatctggcagctggactgcacccacctggagggcaagatcatcctggtggccgtgcacgtggcctccggctacatcgaggccgaggtgatccccgccgagaccggccaggagaccgcctacttcatcctgaagctggccggccgctggcccgtgaaggtgatccacaccgacaacggctccaacttcacctccgccgccgtgaaggccgcctgctggtgggccggcatccagcaggagttcggcatcccctacaacccccagtcccagggcgtggtggagtccatgaacaaggagctgaagaagctgatcggccaggtgcgcgaccaggccgagcacctgaagaccgccgtgcagatggccgtgttcatccacaacttcaagcgcaagggcggcatcggcggctactccgccggcgagcgcatcgtggacatcatcgccaccgacatccagacccgcgagctgcagaagcagatcatcaagatccagaacttccgcgtgtactaccgcgactcccgcgaccccatctggaagggccccgccaagctgctgtggaagggcgagggcgccgtggtgatccaggacaactccgacatcaaggtggtgccccgccgcaaggccaagatcatcaaggactacggcaagcagatggccggcgccgactgcgtggccggccgccaggacgaggactaa

SEQ ID NO: 255 - DNA, 3009 bp, Human immunodeficiency virus
ttcttccgcgagaacctggccttccagcagcgcaaggcccgcgagctgccctccgagcagacccgcgccaactcccccacctcccgcgagctgcgcgtgtggggcggcgacaacaccctgtccgagaccggcgccgagcgccagggcgccgtgtccctgtccttcccccagatcaccctgtggcagcgccccctggtgaccgtgaagatcggcggccagctgaaggaggccctgctggacaccggcgccgacgacaccgtgctggaggagatgaacctgcccggcaagtggaagcccaagatgatcggcggcatcggcggcttcatcaaggtgcgccagtacgaccagatcctgatcgagatctgcggctacaaggccatcggcaccgtgctggtgggccccacccccgtgaacatcatcggccgcaacctgctgacccagatcggctgcaccctgaacttccccatctcccccatcgagaccgtgcccgtgaagctgaagcccggcatggacggccccaaggtgaagcagtggcccctgaccgaggagaagatcaaggccctgaccgagatctgcaccgagatggagaaggagggcaagatctcccgcatcggccccgagaacccctacaacacccccatcttcgccatcaagaagaaggactccaccaagtggcgcaagctggtggacttccgcgagctgaacaagcgcacccaggacttctgggaggtgcagctgggcatcccccaccccgccggcctgaagaagaagaagtccgtgaccgtgctggacgtgggcgacgcctacttctccgtgcccctgtacgaggacttccgcaagtacaccgccttcaccatcccctccatcaacaacgagacccccggcatccgctaccagtacaacgtgctgccccagggctggaagggctcccccgccatcttccagtcctccatgaccaagatcctggagcccttccgcaagcagaaccccgagatggtgatctaccagtacatggacgacctgtacgtgggctccgacctggagatcggccagcaccgcatcaagatcgaggagctgcgcggccacctgctgaagtggggcttcaccacccccgacaagaagcaccagaaggagccccccttcctgtggatgggctacgagctgcaccccgacaagtggaccgtgcagcccatccagctgcccgagaaggactcctggaccgtgaacgacatccagaagctggtgggcaagctgaactgggcctcccagatctaccccggcatcaaggtgcgccagctgtgcaagctgctgcgcggcgccaaggccctgaccgacatcgtgcccctgaccgaggaggccgagctggagctggccgagaaccgcgagatcctgaaggagcccgtgcacggcgtgtactacgacccctccaaggacctgatcgccgagatccagaagcagggccaggaccagtggacctaccagatctaccaggagccccacaagaacctgaagaccggcaagtacgccaagcgccgcaccgcccacaccaacgacgtgaagcagctgaccgaggccgtgcagaagatcgcccaggagtccatcgtgatctggggcaagacccccaagttccgcctgcccatccagaaggagacctgggagacctggtggaccgactactggcaggccacctggatccccgagtgggagttcgtgaacaccccccccctggtgaagctgtggtaccagctggagaaggagcccatcgtgggcgccgagaccttctacgtggacggcgccgccaaccgcgagaccaagctgggcaaggccggctacgtgaccgaccgcggccgccagaaggtgatctccatcaccgacaccaccaaccagaagaccgagctgcaggccatcaacctggccctgcaggactccggctccgaggtgaacatcgtgaccgactcccagtacgccctgggcatcatccaggcccagcccgacaagtccgagtccgagctggtgaaccagatcatcgagcagctgatcaagaaggagaaggtgtacctgtcctgggtgcccgcccacaagggcatcggcggcaacgagcaggtggacaagctggtgtcctccggcatccgcaaggtgctgttcctggacggcatcgacaaggcccaggaggagcacgagaagtaccacaacaactggcgcgccatggcctccgacttcaacctgccccccgtggtggccaaggagatcgtggcctcctgcgacaagtgccagctgaagggcgaggccctgcacggccaggtggactgctcccccggcatctggcagctggactgcacccacctggagggcaaggtgatcctggtggccgtgcacgtggcctccggctacatcgaggccgaggtgatccccgccgagaccggccaggagaccgcctacttcctgctgaagctggccggccgctggcccgtgaaggtggtgcacaccgacaacggctccaacttcacctccgccgccgtgaaggccgcctgctggtgggccggcatcaagcaggagttcggcatcccctacaacccccagtcccagggcgtggtggagtccatgaacaaggagctgaagaagatcatcggccaggtgcgcgaccaggccgagcacctgaagaccgccgtgcagatggccgtgttcatccacaacttcaagcgcaagggcggcatcggcggctactccgccggcgagcgcatcatcgacatcatcgccaccgacatccagaccaaggagctgcagaagcagatcatcaagatccagaacttccgcgtgtactaccgcgactcccgcgaccccatctggaagggccccgccaagctgctgtggaagggcgagggcgccgtggtgatccaggacaactccgacatcaaggtggtgccccgccgcaaggtgaagatcatcaaggactacggcaagcagatggccggcgccgactgcgtggcctcccgccaggacgaggaccag

SEQ ID NO: 256 - protein, 1002 aa, Human immunodeficiency virus
FFRENLAFQQGEAREFSPEQARANSPTSRELRVRGGDSPLPETGAEGEGAISFNFPQITLWQRPLVTIKVAGQLKEALLDTGADDTVLEEIDLPGRWKPKMIGGIGGFIKVRQYEEIIIEIEGKKAIGTVLVGPTPVNIIGRNMLTQIGCTLNFPISPIDTVPVKLKPGMDGPKVKQWPLTEEKIKALTEICTEMEKEGKISKIGPENPYNTPVFAIKKKDSTKWRKLVDFRELNKRTQDFWEVQLGIPHPAGLKKKKSVTVLDVGDAYFSVPLDESFRKYTAFTIPSINNETPGIRYQYNVLPQGWKGSPAIFQSSMTKILEPFRTQNPEIVIYQYMDDLYVGSDLEIGQHREKVEELRKHLLKWGFTTPDKKHQKEPPFLWMGYELHPDKWTVQPIQLPDKECWTVNDIQKLVGKLNWASQIYPGIKVKQLCKLLRGTKALTDIVPLTAEAELELAENREILKEPVHGVYYDPSKDLIAEVQKQGLDQWTYQIYQEPFKNLKTGKYAKRRTAHTNDVRQLAEVVQKISMESIVIWGKIPKFRLPIQRETWETWWTDYWQATWIPEWEFVNTPPLVKLWYQLEKEPIIGAETFYVDGAANRETKLGKAGYVTDKGRQKVVTLTETTNQKTELEAIHLALQDSGLEVNIVTDSQYALGIIQAQPDKSESELVSQIIEQLIKKEKVYLSWVPAHKGIGGNEQVDKLVSSGIRKVLFLDGIDKAQEEHERYHSNWRAMASDFNLPPIVAKEIVASCDKCQLKGEAMHGQVDCSPGIWQLDCTHLEGKIILVAVHVASGYIEAEVIPAETGQETAYFILKLAGRWPVKVIHTDNGSNFTSAAVKAACWWANIQQEFGIPYNPQSQGVVESMNKELKKIIGQVREQAEHLKTAVQMAVFIHNFKRKGGIGGYSAGERIVDIIATDLQTKELQKQITKIQNFRVYYRDSRDPIWKGPAKLLWKGEGAVVIQDNSDIKVVPRRKAKIIRDYGKQMAGDDCVAGRQDED

SEQ ID NO: 257 - protein, 1003 aa, Human immunodeficiency virus
FFRENLAFQQGEARKFPSEQARANSPASRELWVRRGDNPLSEAGAERRGTVPSLSFPQITLWQRPLVTIKVGGQLKEALLDTGADDTVLEDINLPGKWKPKMIGGIGGFIKVKQYDNILIEICGHKAIGTVLVGPTPVNIIGRNLLTQLGCTLNFPISPIETVPVKLKPGMDGPKVKQWPLTEEKIKALTEICTEMEKEGKISKIGPENPYNTPVFAIKKKDSTKWRKLVDFRELNKRTQDFWEVQLGIPHPAGLKKKKSVTVLDVGDAYFSVPLDKDFRKYTAFTIPSVNNETPGIRYQYNVLPQGWKGSPAIFQSSMTKILEPFRKQNPDIVIYQYMDDLYVGSDLEIGQHRTKIEELRQHLLRWGFTTPDKKHQKEPPFLWMGYELHPDKWTVQPIVLPEKDSWTVNDIQKLVGKLNWASQIYPGIKVKQLCRLLRGTKALTEVIPLTKEAELELAENREILKEPVHGVYYDPSKDLIAEIQKQGQGQWTYQIYQEPFKNLKTGKYARMRGAHTNDVKQLTEAVQKITTESIVIWGKTPKFRLPILKETWDTWWTEYWQATWIPEWEFVNTPPLVKLWYQLETEPIAGAETFYVDGASNRETKKGKAGYVTDRGRQKAVSLTETTNQKAELHAIQLALQDSGSEVNIVTDSQYALGIIQAQPDKSESELVNQIIEQLIKKEKVYLSWVPAHKGIGGNEQVDKLVSAGIRKILFLDGIDKAQEEHEKYHNNWRAMASDFNLPPVVAKEIVASCDKCQLKGEAMHGQVDCSPGIWQLDCTHLEGKIILVAVHVASGYLEAEVIPAETGQETAYFILKLAGRWPVKTIHTDNGPNFSSAAVKAACWWAGIQQEFGIPYNPQSQGVVESMNKELKKIIRQVRDQAEHLKTAVQMAVFIHNFKRKGGIGGYSAGERIIDIISTDIQTRELQKQIIKIQNFRVYYRDSRDPVWKGPAKLLWKGEGAVVIQDNSEIKVVPRRKAKIIRDYGKQMAGDDCVAGRQDED

SEQ ID NO: 258 - DNA, 3009 bp, Human immunodeficiency virus
ttcttccgcgagaacctggccttccagcagggcgaggcccgcgagttctcccccgagcaggcccgcgccaactcccccacctcccgcgagctgcgcgtgcgcggcggcgactcccccctgcccgagaccggcgccgagggcgagggcgccatctccttcaacttcccccagatcaccctgtggcagcgccccctggtgaccatcaaggtggccggccagctgaaggaggccctgctggacaccggcgccgacgacaccgtgctggaggagatcgacctgcccggccgctggaagcccaagatgatcggcggcatcggcggcttcatcaaggtgcgccagtacgaggagatcatcatcgagatcgagggcaagaaggccatcggcaccgtgctggtgggccccacccccgtgaacatcatcggccgcaacatgctgacccagatcggctgcaccctgaacttccccatctcccccatcgacaccgtgcccgtgaagctgaagcccggcatggacggccccaaggtgaagcagtggcccctgaccgaggagaagatcaaggccctgaccgagatctgcaccgagatggagaaggagggcaagatctccaagatcggccccgagaacccctacaacacccccgtgttcgccatcaagaagaaggactccaccaagtggcgcaagctggtggacttccgcgagctgaacaagcgcacccaggacttctgggaggtgcagctgggcatcccccaccccgccggcctgaagaagaagaagtccgtgaccgtgctggacgtgggcgacgcctacttctccgtgcccctggacgagtccttccgcaagtacaccgccttcaccatcccctccatcaacaacgagacccccggcatccgctaccagtacaacgtgctgccccagggctggaagggctcccccgccatcttccagtcctccatgaccaagatcctggagcccttccgcacccagaaccccgagatcgtgatctaccagtacatggacgacctgtacgtgggctccgacctggagatcggccagcaccgcgagaaggtggaggagctgcgcaagcacctgctgaagtggggcttcaccacccccgacaagaagcaccagaaggagccccccttcctgtggatgggctacgagctgcaccccgacaagtggaccgtgcagcccatccagctgcccgacaaggagtgctggaccgtgaacgacatccagaagctggtgggcaagctgaactgggcctcccagatctaccccggcatcaaggtgaagcagctgtgcaagctgctgcgcggcaccaaggccctgaccgacatcgtgcccctgaccgccgaggccgagctggagctggccgagaaccgcgagatcctgaaggagcccgtgcacggcgtgtactacgacccctccaaggacctgatcgccgaggtgcagaagcagggcctggaccagtggacctaccagatctaccaggagcccttcaagaacctgaagaccggcaagtacgccaagcgccgcaccgcccacaccaacgacgtgcgccagctggccgaggtggtgcagaagatctccatggagtccatcgtgatctggggcaagatccccaagttccgcctgcccatccagcgcgagacctgggagacctggtggaccgactactggcaggccacctggatccccgagtgggagttcgtgaacaccccccccctggtgaagctgtggtaccagctggagaaggagcccatcatcggcgccgagaccttctacgtggacggcgccgccaaccgcgagaccaagctgggcaaggccggctacgtgaccgacaagggccgccagaaggtggtgaccctgaccgagaccaccaaccagaagaccgagctggaggccatccacctggccctgcaggactccggcctggaggtgaacatcgtgaccgactcccagtacgccctgggcatcatccaggcccagcccgacaagtccgagtccgagctggtgtcccagatcatcgagcagctgatcaagaaggagaaggtgtacctgtcctgggtgcccgcccacaagggcatcggcggcaacgagcaggtggacaagctggtgtcctccggcatccgcaaggtgctgttcctggacggcatcgacaaggcccaggaggagcacgagcgctaccactccaactggcgcgccatggcctccgacttcaacctgccccccatcgtggccaaggagatcgtggcctcctgcgacaagtgccagctgaagggcgaggccatgcacggccaggtggactgctcccccggcatctggcagctggactgcacccacctggagggcaagatcatcctggtggccgtgcacgtggcctccggctacatcgaggccgaggtgatccccgccgagaccggccaggagaccgcctacttcatcctgaagctggccggccgctggcccgtgaaggtgatccacaccgacaacggctccaacttcacctccgccgccgtgaaggccgcctgctggtgggccaacatccagcaggagttcggcatcccctacaacccccagtcccagggcgtggtggagtccatgaacaaggagctgaagaagatcatcggccaggtgcgcgagcaggccgagcacctgaagaccgccgtgcagatggccgtgttcatccacaacttcaagcgcaagggcggcatcggcggctactccgccggcgagcgcatcgtggacatcatcgccaccgacctgcagaccaaggagctgcagaagcagatcaccaagatccagaacttccgcgtgtactaccgcgactcccgcgaccccatctggaagggccccgccaagctgctgtggaagggcgagggcgccgtggtgatccaggacaactccgacatcaaggtggtgccccgccgcaaggccaagatcatccgcgactacggcaagcagatggccggcgacgactgcgtggccggccgccaggacgaggactaa

SEQ ID NO: 259 - DNA, 3012 bp, Human immunodeficiency virus
ttcttccgcgagaacctggccttccagcagggcgaggcccgcaagttcccctccgagcaggcccgcgccaactcccccgcctcccgcgagctgtgggtgcgccgcggcgacaaccccctgtccgaggccggcgccgagcgccgcggcaccgtgccctccctgtccttcccccagatcaccctgtggcagcgccccctggtgaccatcaaggtgggcggccagctgaaggaggccctgctggacaccggcgccgacgacaccgtgctggaggacatcaacctgcccggcaagtggaagcccaagatgatcggcggcatcggcggcttcatcaaggtgaagcagtacgacaacatcctgatcgagatctgcggccacaaggccatcggcaccgtgctggtgggccccacccccgtgaacatcatcggccgcaacctgctgacccagctgggctgcaccctgaacttccccatctcccccatcgagaccgtgcccgtgaagctgaagcccggcatggacggccccaaggtgaagcagtggcccctgaccgaggagaagatcaaggccctgaccgagatctgcaccgagatggagaaggagggcaagatctccaagatcggccccgagaacccctacaacacccccgtgttcgccatcaagaagaaggactccaccaagtggcgcaagctggtggacttccgcgagctgaacaagcgcacccaggacttctgggaggtgcagctgggcatcccccaccccgccggcctgaagaagaagaagtccgtgaccgtgctggacgtgggcgacgcctacttctccgtgcccctggacaaggacttccgcaagtacaccgccttcaccatcccctccgtgaacaacgagacccccggcatccgctaccagtacaacgtgctgccccagggctggaagggctcccccgccatcttccagtcctccatgaccaagatcctggagcccttccgcaagcagaaccccgacatcgtgatctaccagtacatggacgacctgtacgtgggctccgacctggagatcggccagcaccgcaccaagatcgaggagctgcgccagcacctgctgcgctggggcttcaccacccccgacaagaagcaccagaaggagccccccttcctgtggatgggctacgagctgcaccccgacaagtggaccgtgcagcccatcgtgctgcccgagaaggactcctggaccgtgaacgacatccagaagctggtgggcaagctgaactgggcctcccagatctaccccggcatcaaggtgaagcagctgtgccgcctgctgcgcggcaccaaggccctgaccgaggtgatccccctgaccaaggaggccgagctggagctggccgagaaccgcgagatcctgaaggagcccgtgcacggcgtgtactacgacccctccaaggacctgatcgccgagatccagaagcagggccagggccagtggacctaccagatctaccaggagcccttcaagaacctgaagaccggcaagtacgcccgcatgcgcggcgcccacaccaacgacgtgaagcagctgaccgaggccgtgcagaagatcaccaccgagtccatcgtgatctggggcaagacccccaagttccgcctgcccatcctgaaggagacctgggacacctggtggaccgagtactggcaggccacctggatccccgagtgggagttcgtgaacaccccccccctggtgaagctgtggtaccagctggagaccgagcccatcgccggcgccgagaccttctacgtggacggcgcctccaaccgcgagaccaagaagggcaaggccggctacgtgaccgaccgcggccgccagaaggccgtgtccctgaccgagaccaccaaccagaaggccgagctgcacgccatccagctggccctgcaggactccggctccgaggtgaacatcgtgaccgactcccagtacgccctgggcatcatccaggcccagcccgacaagtccgagtccgagctggtgaaccagatcatcgagcagctgatcaagaaggagaaggtgtacctgtcctgggtgcccgcccacaagggcatcggcggcaacgagcaggtggacaagctggtgtccgccggcatccgcaagatcctgttcctggacggcatcgacaaggcccaggaggagcacgagaagtaccacaacaactggcgcgccatggcctccgacttcaacctgccccccgtggtggccaaggagatcgtggcctcctgcgacaagtgccagctgaagggcgaggccatgcacggccaggtggactgctcccccggcatctggcagctggactgcacccacctggagggcaagatcatcctggtggccgtgcacgtggcctccggctacctggaggccgaggtgatccccgccgagaccggccaggagaccgcctacttcatcctgaagctggccggccgctggcccgtgaagaccatccacaccgacaacggccccaacttctcctccgccgccgtgaaggccgcctgctggtgggccggcatccagcaggagttcggcatcccctacaacccccagtcccagggcgtggtggagtccatgaacaaggagctgaagaagatcatccgccaggtgcgcgaccaggccgagcacctgaagaccgccgtgcagatggccgtgttcatccacaacttcaagcgcaagggcggcatcggcggctactccgccggcgagcgcatcatcgacatcatctccaccgacatccagacccgcgagctgcagaagcagatcatcaagatccagaacttccgcgtgtactaccgcgactcccgcgaccccgtgtggaagggccccgccaagctgctgtggaagggcgagggcgccgtggtgatccaggacaactccgagatcaaggtggtgccccgccgcaaggccaagatcatccgcgactacggcaagcagatggccggcgacgactgcgtggccggccgccaggacgaggactaa

SEQ ID NO: 260 - protein, 1002 aa, Human immunodeficiency virus
FFRENLAFQQGEAREFSPEQARANSPTRRELWVRRGDSPLPEARAEGKGDIPLSLPQITLWQRPLVTVRIGGQLIEALLDTGADDTVLEDINLPGKWKPKMIGGIGGFIKVRQYDQILIEICGKKAIGTVLVGPTPINIIGRNMLTQIGCTLNFPISPIETVPVKLKPGMDGPKVKQWPLTEEKIKALTDICTEMEREGKISKIGPENPYNTPIFAIKKKDSTKWRKLVDFRELNKRTQDFWEVQLGIPHPSGLKKKKSVTVLDVGDAYFSVPLDESFRKYTAFTIPSTNNETPGIRYQYNVLPQGWKGSPAIFQSSMTKILEPFRIKNPEIVIYQYMDDLYVGSDLEIGQHRAKIEELRKHLLSWGFTTPDKKHQKEPPFLWMGYELHPDKWTVQPIQLPDKESWTVNDIQKLVGKLNWASQIYPGIKVKQLCKLLRGAKALTDIVPLTAEAELELAENREILKEPVHGVYYEPSKELIAEVQKQGLDQWTYQIYQEPYKNLKTGKYAKRGSAHTNDVKQLTEVVQKIATESIVIWGKTPKFKLPIRKETWEVWWTEYWQATWIPDWEFVNTPPLVKLWYRLETEPIAGAETYYVDGAANRETKLGKAGYVTDKGKQKIITLTETTNQKAELQAIHIALQDSGSEVNIVTDSQYALGIIQAQPDRSESEVVNQIIEQLIKKEKVYLSWVPAHKGIGGNEQVDKLVSSGIRKVLFLDGIDKAQEEHEKYHSNWRAMASDFNLPPVVAKEIVASCDKCQLKGEAMHGQVDCSPGIWQLDCTHLEGKIILVAVHVASGYIEAEVIPAETGQETAYFILKLAGRWPVKIIHTDNGSNFTSAAVKAACWWANITQEFGIPYNPQSQGVVESMNKELKKIIGQVRDQAEHLKTAVQMAVFIHNFKRKGGIGGYSAGERIIDIIASDIQTKELQKQITKIQNFRVYFRDSRDPIWKGPAKLLWKGEGAVVIQDNNEIKVVPRRKAKIIRDYGKQMAGDDCVAGRQDED

SEQ ID NO: 261 - DNA, 3009 bp, Human immunodeficiency virus
ttcttccgcgagaacctggccttccagcagggcgaggcccgcgagttctcccccgagcaggcccgcgccaactcccccacccgccgcgagctgtgggtgcgccgcggcgactcccccctgcccgaggcccgcgccgagggcaagggcgacatccccctgtccctgccccagatcaccctgtggcagcgccccctggtgaccgtgcgcatcggcggccagctgatcgaggccctgctggacaccggcgccgacgacaccgtgctggaggacatcaacctgcccggcaagtggaagcccaagatgatcggcggcatcggcggcttcatcaaggtgcgccagtacgaccagatcctgatcgagatctgcggcaagaaggccatcggcaccgtgctggtgggccccacccccatcaacatcatcggccgcaacatgctgacccagatcggctgcaccctgaacttccccatctcccccatcgagaccgtgcccgtgaagctgaagcccggcatggacggccccaaggtgaagcagtggcccctgaccgaggagaagatcaaggccctgaccgacatctgcaccgagatggagcgcgagggcaagatctccaagatcggccccgagaacccctacaacacccccatcttcgccatcaagaagaaggactccaccaagtggcgcaagctggtggacttccgcgagctgaacaagcgcacccaggacttctgggaggtgcagctgggcatcccccacccctccggcctgaagaagaagaagtccgtgaccgtgctggacgtgggcgacgcctacttctccgtgcccctggacgagtccttccgcaagtacaccgccttcaccatcccctccaccaacaacgagacccccggcatccgctaccagtacaacgtgctgccccagggctggaagggctcccccgccatcttccagtcctccatgaccaagatcctggagcccttccgcatcaagaaccccgagatcgtgatctaccagtacatggacgacctgtacgtgggctccgacctggagatcggccagcaccgcgccaagatcgaggagctgcgcaagcacctgctgtcctggggcttcaccacccccgacaagaagcaccagaaggagccccccttcctgtggatgggctacgagctgcaccccgacaagtggaccgtgcagcccatccagctgcccgacaaggagtcctggaccgtgaacgacatccagaagctggtgggcaagctgaactgggcctcccagatctaccccggcatcaaggtgaagcagctgtgcaagctgctgcgcggcgccaaggccctgaccgacatcgtgcccctgaccgccgaggccgagctggagctggccgagaaccgcgagatcctgaaggagcccgtgcacggcgtgtactacgagccctccaaggagctgatcgccgaggtgcagaagcagggcctggaccagtggacctaccagatctaccaggagccctacaagaacctgaagaccggcaagtacgccaagcgcggctccgcccacaccaacgacgtgaagcagctgaccgaggtggtgcagaagatcgccaccgagtccatcgtgatctggggcaagacccccaagttcaagctgcccatccgcaaggagacctgggaggtgtggtggaccgagtactggcaggccacctggatccccgactgggagttcgtgaacaccccccccctggtgaagctgtggtaccgcctggagaccgagcccatcgccggcgccgagacctactacgtggacggcgccgccaaccgcgagaccaagctgggcaaggccggctacgtgaccgacaagggcaagcagaagatcatcaccctgaccgagaccaccaaccagaaggccgagctgcaggccatccacatcgccctgcaggactccggctccgaggtgaacatcgtgaccgactcccagtacgccctgggcatcatccaggcccagcccgaccgctccgagtccgaggtggtgaaccagatcatcgagcagctgatcaagaaggagaaggtgtacctgtcctgggtgcccgcccacaagggcatcggcggcaacgagcaggtggacaagctggtgtcctccggcatccgcaaggtgctgttcctggacggcatcgacaaggcccaggaggagcacgagaagtaccactccaactggcgcgccatggcctccgacttcaacctgccccccgtggtggccaaggagatcgtggcctcctgcgacaagtgccagctgaagggcgaggccatgcacggccaggtggactgctcccccggcatctggcagctggactgcacccacctggagggcaagatcatcctggtggccgtgcacgtggcctccggctacatcgaggccgaggtgatccccgccgagaccggccaggagaccgcctacttcatcctgaagctggccggccgctggcccgtgaagatcatccacaccgacaacggctccaacttcacctccgccgccgtgaaggccgcctgctggtgggccaacatcacccaggagttcggcatcccctacaacccccagtcccagggcgtggtggagtccatgaacaaggagctgaagaagatcatcggccaggtgcgcgaccaggccgagcacctgaagaccgccgtgcagatggccgtgttcatccacaacttcaagcgcaagggcggcatcggcggctactccgccggcgagcgcatcatcgacatcatcgcctccgacatccagaccaaggagctgcagaagcagatcaccaagatccagaacttccgcgtgtacttccgcgactcccgcgaccccatctggaagggccccgccaagctgctgtggaagggcgagggcgccgtggtgatccaggacaacaacgagatcaaggtggtgccccgccgcaaggccaagatcatccgcgactacggcaagcagatggccggcgacgactgcgtggccggccgccaggacgaggactaa

SEQ ID NO: 262 - protein, 15 aa, Human immunodeficiency virus
DTEVHNVWATHACVP

SEQ ID NO: 263 - protein, 15 aa, Human immunodeficiency virus
KNSSEYYRLINCNTS

SEQ ID NO: 264 - protein, 15 aa, Human immunodeficiency virus
EYYRLINCNTSAITQ

SEQ ID NO: 265 - protein, 15 aa, Human immunodeficiency virus
CPKVSFEPIPIHYCA

SEQ ID NO: 266 - protein, 15 aa, Human immunodeficiency virus
SFEPIPIHYCAPAGF

SEQ ID NO: 267 - protein, 15 aa, Human immunodeficiency virus
NVSTVQCTHGIKPVV

SEQ ID NO: 268 - protein, 15 aa, Human immunodeficiency virus
ETITLPCRIKQIINM

SEQ ID NO: 269 - protein, 15 aa, Human immunodeficiency virus
LPCRIKQIINMWQGV

SEQ ID NO: 270 - protein, 15 aa, Human immunodeficiency virus
GIVQQQSNLLRAIEA

SEQ ID NO: 271 - protein, 16 aa, Human immunodeficiency virus
VQQSNLLRAIEAQQHL

SEQ ID NO: 272 - protein, 17 aa, Human immunodeficiency virus
AQQHLLQLTVWGIKQLQ

SEQ ID NO: 273 - protein, 16 aa, Human immunodeficiency virus
LQLTVWGIKQLQARVL

SEQ ID NO: 274 - protein, 15 aa, Human immunodeficiency virus
AKAYDTEVHNVWATQ

SEQ ID NO: 275 - protein, 15 aa, Human immunodeficiency virus
DTEVHNVWATQACVP

SEQ ID NO: 276 - protein, 15 aa, Human immunodeficiency virus
ACPKISFEPIPIHYC

SEQ ID NO: 277 - protein, 15 aa, Human immunodeficiency virus
ISFEPIPIHYCAPAG

SEQ ID NO: 278 - protein, 15 aa, Human immunodeficiency virus
RKRIHIGPGRAFYTT

SEQ ID NO: 279 - protein, 15 aa, Human immunodeficiency virus
HIGPGRAFYTTKNII

SEQ ID NO: 280 - protein, 15 aa, Human immunodeficiency virus
IVQQQNNLLRAIEAQ

SEQ ID NO: 281 - protein, 15 aa, Human immunodeficiency virus
QNNLLRAIEAQQHML

SEQ ID NO: 282 - protein, 20 aa, Human immunodeficiency virus
VPVWKEAKTTLFCASDAKSY

SEQ ID NO: 283 - protein, 20 aa, Human immunodeficiency virus
GKEVHNVWATHACVPTDPNP

SEQ ID NO: 284 - protein, 20 aa, Human immunodeficiency virus
SSENSSEYYRLINCNTSAIT

SEQ ID NO: 285 - protein, 20 aa, Human immunodeficiency virus
STVQCTHGIKPVVSTQLLLN

SEQ ID NO: 286 - protein, 20 aa, Human immunodeficiency virus
QQSNLLRAIEAQQHLLQLTV

SEQ ID NO: 287 - protein, 20 aa, Human immunodeficiency virus
AQQHLLQLTVWGIKQLQTRV

SEQ ID NO: 288 - protein, 15 aa, Human immunodeficiency virus
GIQRNCQHLWRWGTM

SEQ ID NO: 289 - protein, 15 aa, Human immunodeficiency virus
NCQHLWRWGTMILGM

SEQ ID NO: 290 - protein, 15 aa, Human immunodeficiency virus
DTEVHNVWATHACVP

SEQ ID NO: 291 - protein, 15 aa, Human immunodeficiency virus
CPKVSFEPIPIHYCA

SEQ ID NO: 292 - protein, 15 aa, Human immunodeficiency virus
FYCNTSGLFNSTWMF

SEQ ID NO: 293 - protein, 15 aa, Human immunodeficiency virus
FNSTWMFNGTYMFNG

SEQ ID NO: 294 - protein, 15 aa, Human immunodeficiency virus
GIRRNYQHWWGWGTM

SEQ ID NO: 295 - protein, 15 aa, Human immunodeficiency virus
NYQHWWGWGTMLLGL

SEQ ID NO: 296 - protein, 15 aa, Human immunodeficiency virus
NMWKNNMVEQMHEDI

SEQ ID NO: 297 - protein, 15 aa, Human immunodeficiency virus
ISFEPIPIHYCAPAG

SEQ ID NO: 298 - protein, 15 aa, Human immunodeficiency virus
NIIGTIRQAHCNISR

SEQ ID NO: 299 - protein, 15 aa, Human immunodeficiency virus
TIRQAHCNISRAKWN

SEQ ID NO: 300 - protein, 20 aa, Human immunodeficiency virus
MRVTGIRKNYQHLWRWGTML

SEQ ID NO: 301 - protein, 18 aa, Human immunodeficiency virus
RWGTMLLGMLMICSAAEN

SEQ ID NO: 302 - protein, 20 aa, Human immunodeficiency virus
GKEVHNVWATHACVPTDPNP

SEQ ID NO: 303 - protein, 20 aa, Human immunodeficiency virus
GDIRQAHCNISKDKWNETLQ

SEQ ID NO: 304 - protein, 20 aa, Human immunodeficiency virus
LLGIWGCSGKLICTTTVPWN

SEQ ID NO: 305 - DNA, 17 bp, Artificial Sequence
  Description of Artificial Sequence: Synthetic Oligonucleotide
ttcagtcgacggccacc

SEQ ID NO: 306 - DNA, 11 bp, Artificial Sequence
  Description of Artificial Sequence: Synthetic Oligonucleotide
gccaccatgga

SEQ ID NO: 307 - DNA, 14 bp, Artificial Sequence
  Description of Artificial Sequence: Synthetic Oligonucleotide
taaagatcttacaa

SEQ ID NO: 308 - protein, 16 aa, Human immunodeficiency virus
KQIINMWQVVGKAMYA

SEQ ID NO: 309 - protein, 36 aa, Human immunodeficiency virus
YKRWIILGLNKIVRMYTNVNVTNTTNNTEEKGEIKN

SEQ ID NO: 310 - protein, 49 aa, Human immunodeficiency virus
YKRWIILGLNKIVRMYTEIRDKKQKVYALFYRLDVVPIDDNNNNSSNYR

SEQ ID NO: 311 - protein, 38 aa, Human immunodeficiency virus
YKRWIILGLNKIVRMYTRPNNNTRKSIRIGPGQAFYAT

SEQ ID NO: 312 - protein, 44 aa, Human immunodeficiency virus
YKRWIILGLNKIVRMYNTSGLFNSTWIGNGTKNNNNTNDTITLP

SEQ ID NO: 313 - protein, 36 aa, Human immunodeficiency virus
YKRWIILGLNKIVRMYRDGGNNNTNETEIFRPGGGD

SEQ ID NO: 314 - protein, 35 aa, Human immunodeficiency virus
YKRWIILGLNKIVRMYNVRNVSSNGTETDNEEIKN

SEQ ID NO: 315 - protein, 56 aa, Human immunodeficiency virus
YKRWIILGLNKIVRMYTELRDKKQKVYALFYRLDVVPIDDKNSSEISGKNSSEYYR

SEQ ID NO: 316 - protein, 38 aa, Human immunodeficiency virus
YKRWIILGLNKIVRMYTRPNNNTRKSIHIGPGQAFYAT

SEQ ID NO: 317 - protein, 47 aa, Human immunodeficiency virus
YKRWIILGLNKIVRMYNTSGLFNSTWMFNGTYMFNGTKDNSETITLP

SEQ ID NO: 318 - protein, 37 aa, Human immunodeficiency virus
YKRWIILGLNKIVRMYRDGGNNSNKNKTETFRPGGGD

SEQ ID NO: 319 - protein, 4 aa, Human immunodeficiency virus
REKR

SEQ ID NO: 320 - protein, 26 aa, Human immunodeficiency virus
YIKIFIMIVGGLIGLRIVFAVLSIVN

SEQ ID NO: 321 - protein, 7 aa, Human immunodeficiency virus
ELDKWAS

SEQ ID NO: 322 - protein, 22 aa, Human immunodeficiency virus
VFNHSSGGDPEIVMHSFNCGGE

---

What is claimed is:

1. A method of preparing an immunogenic composition comprising admixing DU123.6 gp140CF with a pharmaceutically acceptable carrier.

* * * * *